United States Patent 12,606,847 (ENGINEERED VIRAL CAPSID POLYPEPTIDES AND USES THEREOF) - sequence listing, part 10

SEQ ID NO: 198648 - protein, 36 aa, Artificial Sequence
  Description of Artificial Sequence: Synthetic polypeptide
CEEEISTTNPVATMQWGVSIPNCINMDSTADGGNNY

SEQ ID NO: 198649 - protein, 37 aa, Artificial Sequence
  Description of Artificial Sequence: Synthetic polypeptide
TGQEIATTNPVAYEQWGSCVQNGGNAGEDLRREGDND

SEQ ID NO: 198650 - protein, 32 aa, Artificial Sequence
  Description of Artificial Sequence: Synthetic polypeptide
QEGEIASTNPCSYEQWGITCYCNDQQSDGDTR

SEQ ID NO: 198651 - protein, 36 aa, Artificial Sequence
  Description of Artificial Sequence: Synthetic polypeptide
DENAEIATTNPVAYEKWGEVAWGEQEQGNHGNGNGR

SEQ ID NO: 198652 - protein, 37 aa, Artificial Sequence
  Description of Artificial Sequence: Synthetic polypeptide
SAEEIATTNPVATEQYGSACAANNGLPADAPGDEMGH

SEQ ID NO: 198653 - protein, 35 aa, Artificial Sequence
  Description of Artificial Sequence: Synthetic polypeptide
TNCEIATTNPVAYEQWGSCATGGLNDERNMDRGEE

SEQ ID NO: 198654 - protein, 34 aa, Artificial Sequence
  Description of Artificial Sequence: Synthetic polypeptide
TNCEIATTNPVAYERWGTVYYQPNRPTEQDGNTA

SEQ ID NO: 198655 - protein, 35 aa, Artificial Sequence
  Description of Artificial Sequence: Synthetic polypeptide
AEECIASVNPVCTEQYGCVCSWGEHNQSFGSNTQA

SEQ ID NO: 198656 - protein, 37 aa, Artificial Sequence
  Description of Artificial Sequence: Synthetic polypeptide
DEECISTTNPVATEGYGCVCSNWGEHNIENFNSDNQA

SEQ ID NO: 198657 - protein, 35 aa, Artificial Sequence
  Description of Artificial Sequence: Synthetic polypeptide
AECENATTNPVAYEEWGVVATGGNTGNADGNDNQR

SEQ ID NO: 198658 - protein, 38 aa, Artificial Sequence
  Description of Artificial Sequence: Synthetic polypeptide
DECEICTTNPVATEAYGVVTNTQLQAGTEQGSTTTQED

SEQ ID NO: 198659 - protein, 37 aa, Artificial Sequence
  Description of Artificial Sequence: Synthetic polypeptide
AEECIATTNPVATEQYGCSCPNSGEDNQEHFNSENQA

SEQ ID NO: 198660 - protein, 34 aa, Artificial Sequence
  Description of Artificial Sequence: Synthetic polypeptide
AECENATTNPVAYEEWGVVATGGNTGNAGNDNES

SEQ ID NO: 198661 - protein, 38 aa, Artificial Sequence
  Description of Artificial Sequence: Synthetic polypeptide
DEEEIACTNPVATEQYGSACAATNPDEEEGTHGDEDTP

SEQ ID NO: 198662 - protein, 37 aa, Artificial Sequence
  Description of Artificial Sequence: Synthetic polypeptide
NEEEISTTNPVAYEQYGCVCSNWGEHNAEFFGSDTQS

SEQ ID NO: 198663 - protein, 35 aa, Artificial Sequence
  Description of Artificial Sequence: Synthetic polypeptide
QEEEIRTTNPIATECWGATTWANEEDWQEPKGPYI

SEQ ID NO: 198664 - protein, 34 aa, Artificial Sequence
  Description of Artificial Sequence: Synthetic polypeptide
AEDEIATTNPVAYEQWGCVTGDLNDHPGQQDSPV

SEQ ID NO: 198665 - protein, 38 aa, Artificial Sequence
  Description of Artificial Sequence: Synthetic polypeptide
SAEEIATTNPVATEQYGSCPANAGPALEPDAGTPGDNH

SEQ ID NO: 198666 - protein, 32 aa, Artificial Sequence
  Description of Artificial Sequence: Synthetic polypeptide
QEGEIASTNPCSYEQWGITCYCNDQEHQGDTR

SEQ ID NO: 198667 - protein, 37 aa, Artificial Sequence
  Description of Artificial Sequence: Synthetic polypeptide
DEECISTTNPVATEGYGCVCSNWGEHNAENFNSETQA

SEQ ID NO: 198668 - protein, 38 aa, Artificial Sequence
  Description of Artificial Sequence: Synthetic polypeptide
DEEEIACTNPVATEQYGSACAATNPAEEAGDHGDEDAP

SEQ ID NO: 198669 - protein, 34 aa, Artificial Sequence
  Description of Artificial Sequence: Synthetic polypeptide
TGEAEIATTNPCAYEHWGSVCYNNDDQDHSHNDV

SEQ ID NO: 198670 - protein, 37 aa, Artificial Sequence
  Description of Artificial Sequence: Synthetic polypeptide
DEEAISTTNPVAYEQYGCVCSNWGEHNQENFGSETQS

SEQ ID NO: 198671 - protein, 37 aa, Artificial Sequence
  Description of Artificial Sequence: Synthetic polypeptide
DEEAISTTNPVAYEQYGCVCSNWGEHNAENFNSETQS

SEQ ID NO: 198672 - protein, 36 aa, Artificial Sequence
  Description of Artificial Sequence: Synthetic polypeptide
SAEEIATTNPVATEQWGTVSVGDGPGGPDDQTGGQM

SEQ ID NO: 198673 - protein, 39 aa, Artificial Sequence
  Description of Artificial Sequence: Synthetic polypeptide
DEAEISTTNPVATEQYGQCVCSNWGEDHNAENFGSDNQS

SEQ ID NO: 198674 - protein, 37 aa, Artificial Sequence
  Description of Artificial Sequence: Synthetic polypeptide
DEMEICTTNPVATEQYGCACVCHATMGPTVEFEGGDI

SEQ ID NO: 198675 - protein, 35 aa, Artificial Sequence
  Description of Artificial Sequence: Synthetic polypeptide
TGTAEIATTNPVAYECWGVVSGGLNDDRQEQGNTV

SEQ ID NO: 198676 - protein, 35 aa, Artificial Sequence
  Description of Artificial Sequence: Synthetic polypeptide
SAEEIATTNPVATEQYGCVAAGEGGHGQESPEEEN

SEQ ID NO: 198677 - protein, 36 aa, Artificial Sequence
  Description of Artificial Sequence: Synthetic polypeptide
SAEEIATTNPVATEQYGCVAPGEGGHGINESAEEAN

SEQ ID NO: 198678 - protein, 39 aa, Artificial Sequence
  Description of Artificial Sequence: Synthetic polypeptide
DEEEIRTTNPVATEEYGQCVCSNWGEDHNAENFNSDTQS

SEQ ID NO: 198679 - protein, 36 aa, Artificial Sequence
  Description of Artificial Sequence: Synthetic polypeptide
SAEEIATTNPVATEQYGCVAPGEGGHGINESEEENQ

SEQ ID NO: 198680 - protein, 38 aa, Artificial Sequence
  Description of Artificial Sequence: Synthetic polypeptide
CEEEIRTTNPVATEGYGQCVCSNWGEHNIENFNSDNQE

SEQ ID NO: 198681 - protein, 37 aa, Artificial Sequence
  Description of Artificial Sequence: Synthetic polypeptide
TMDEIRTTNPVATEQYGLSAVAPLEHNDMEPTQNPVV

SEQ ID NO: 198682 - protein, 37 aa, Artificial Sequence
  Description of Artificial Sequence: Synthetic polypeptide
DEEEIACTNPVAYEQYGSACSVAPHLNNEAPGGEAVH

SEQ ID NO: 198683 - protein, 36 aa, Artificial Sequence
  Description of Artificial Sequence: Synthetic polypeptide
SAEEIATTNPVATEQYGCVAPGEGGHGNESGEEADN

SEQ ID NO: 198684 - protein, 37 aa, Artificial Sequence
  Description of Artificial Sequence: Synthetic polypeptide
DDECISTTNPVATEQYGQCVCSWGEHNQENFNSDTQS

SEQ ID NO: 198685 - protein, 38 aa, Artificial Sequence
  Description of Artificial Sequence: Synthetic polypeptide
DEMEICTTNPVATEQYGCACVCHYTDGPTVEPFEGNDI

SEQ ID NO: 198686 - protein, 37 aa, Artificial Sequence
  Description of Artificial Sequence: Synthetic polypeptide
DEEEIACTNPVAYEQYGSACAAANPAEADAEIGNNTA

SEQ ID NO: 198687 - protein, 36 aa, Artificial Sequence
  Description of Artificial Sequence: Synthetic polypeptide
TNAEIATTNPVAYERWGSAVSGMGGLNDDRQHQGNT

SEQ ID NO: 198688 - protein, 36 aa, Artificial Sequence
  Description of Artificial Sequence: Synthetic polypeptide
ESEAEIRTTNPVAYEQWGVVYQWGTNPPGEDGDGDD

SEQ ID NO: 198689 - protein, 36 aa, Artificial Sequence
  Description of Artificial Sequence: Synthetic polypeptide
SAEEIATTNPVATEQYGCVAPGEGGHGNQSGEEDGM

SEQ ID NO: 198690 - protein, 32 aa, Artificial Sequence
  Description of Artificial Sequence: Synthetic polypeptide
QEGEIASTNPCSYEQWGITCYCNDQDSHGHTR

SEQ ID NO: 198691 - protein, 34 aa, Artificial Sequence
  Description of Artificial Sequence: Synthetic polypeptide
TGEAEIATTNPCAYEHWGSVCYNNDDQDHNHTDH

SEQ ID NO: 198692 - protein, 35 aa, Artificial Sequence
  Description of Artificial Sequence: Synthetic polypeptide
TGEAEIATTNPCAYEHWGSVCYNNDDQDGGHNDHQ

SEQ ID NO: 198693 - protein, 38 aa, Artificial Sequence
  Description of Artificial Sequence: Synthetic polypeptide
DDEEISTTNPVATEQYGCAVCSNSGEHNAENFPSENQA

SEQ ID NO: 198694 - protein, 35 aa, Artificial Sequence
  Description of Artificial Sequence: Synthetic polypeptide
QEDEIACTNPVAYEQWGEYYSIENDQQDRTGPGES

SEQ ID NO: 198695 - protein, 35 aa, Artificial Sequence
  Description of Artificial Sequence: Synthetic polypeptide
AEAEIASTNPVGYEAYGQTVMAYSPGNLSQHVGDI

SEQ ID NO: 198696 - protein, 35 aa, Artificial Sequence
  Description of Artificial Sequence: Synthetic polypeptide
NEEEIACTNPVAYEQWGCTAGNGQHTDNEEPDDRH

SEQ ID NO: 198697 - protein, 37 aa, Artificial Sequence
  Description of Artificial Sequence: Synthetic polypeptide
TETEIRTTNCVATEIYGVVNDNNALQHFDEGGQGFDD

SEQ ID NO: 198698 - protein, 36 aa, Artificial Sequence
  Description of Artificial Sequence: Synthetic polypeptide
DEEEIACTNPVATEQYGSACAAPPAEGQDHQDDSAK

SEQ ID NO: 198699 - protein, 35 aa, Artificial Sequence
  Description of Artificial Sequence: Synthetic polypeptide
DEDEIATTNPVATEQWGGCCAGNGHMNAEGHPMEN

SEQ ID NO: 198700 - protein, 38 aa, Artificial Sequence
  Description of Artificial Sequence: Synthetic polypeptide
DSEEIRTTNPVATEQYGSIWWSFPVNEPWNAMITDEQI

SEQ ID NO: 198701 - protein, 36 aa, Artificial Sequence
  Description of Artificial Sequence: Synthetic polypeptide
AENEIACTNPVATEQYGCSCSWEEDHNQNFGSDTQA

SEQ ID NO: 198702 - protein, 37 aa, Artificial Sequence
  Description of Artificial Sequence: Synthetic polypeptide
CEECIRTTNPVAYEQYGCVCSNWGEHNQENFNSDNQA

SEQ ID NO: 198703 - protein, 40 aa, Artificial Sequence
  Description of Artificial Sequence: Synthetic polypeptide
DEEEIRTTNPVATEAYGTVVTVQIGTTEQGSTNDEQNEEE

SEQ ID NO: 198704 - protein, 35 aa, Artificial Sequence
  Description of Artificial Sequence: Synthetic polypeptide
DEQEIRTTNPIATECWGSTTWSNAEDWAEPEGPYI

SEQ ID NO: 198705 - protein, 38 aa, Artificial Sequence
  Description of Artificial Sequence: Synthetic polypeptide
CEEEIRTTNPVATEQYGCVCSNSGEDHDIEHFNSDNQS

SEQ ID NO: 198706 - protein, 37 aa, Artificial Sequence
  Description of Artificial Sequence: Synthetic polypeptide
DENEIRTTNPVATEQWGVVDNGEEGEEMNAGEGDGDT

SEQ ID NO: 198707 - protein, 36 aa, Artificial Sequence
  Description of Artificial Sequence: Synthetic polypeptide
DEEEISTTNPCATEQYGQCVCPWEHNQENFISDTQA

SEQ ID NO: 198708 - protein, 36 aa, Artificial Sequence
  Description of Artificial Sequence: Synthetic polypeptide
SEAEIACTNPVATEQYGSVCNPVDNNHNIDAMGEGA

SEQ ID NO: 198709 - protein, 38 aa, Artificial Sequence
  Description of Artificial Sequence: Synthetic polypeptide
DEEEIACTNPVATEQYGSACAATAGVGGEEHQDDNLAG

SEQ ID NO: 198710 - protein, 38 aa, Artificial Sequence
  Description of Artificial Sequence: Synthetic polypeptide
NEGAIRTTNPVATEQYGCSCVNTEAVTLEIGEIPDQQD

SEQ ID NO: 198711 - protein, 32 aa, Artificial Sequence
  Description of Artificial Sequence: Synthetic polypeptide
QEGEIASTNPCSYEQWGMTCYCNDQDDHGDTR

SEQ ID NO: 198712 - protein, 37 aa, Artificial Sequence
  Description of Artificial Sequence: Synthetic polypeptide
DEDEIATTNPVATEQWGCVCAGTGPVPGDNHPDDSNN

SEQ ID NO: 198713 - protein, 39 aa, Artificial Sequence
  Description of Artificial Sequence: Synthetic polypeptide
DENEIRTTNPVATEQYGAASCMCAFVDLLSEQVVQEDDS

SEQ ID NO: 198714 - protein, 38 aa, Artificial Sequence
  Description of Artificial Sequence: Synthetic polypeptide
DEIAEIATTNPVAYEQWGSVVCGTPDDDHRDNHKDTRN

SEQ ID NO: 198715 - protein, 37 aa, Artificial Sequence
  Description of Artificial Sequence: Synthetic polypeptide
TESEISTTNPVAYEQWGSVYHGENQDLQEGTQGQQIG

SEQ ID NO: 198716 - protein, 38 aa, Artificial Sequence
  Description of Artificial Sequence: Synthetic polypeptide
DEQEIRSTNPVATEQYGVVMGNNDNNTEGPGQTGQTGD

SEQ ID NO: 198717 - protein, 37 aa, Artificial Sequence
  Description of Artificial Sequence: Synthetic polypeptide
DEIAEIATTNPVAYEQWGSVVCGTPDDDHRSNQKDIE

SEQ ID NO: 198718 - protein, 33 aa, Artificial Sequence
  Description of Artificial Sequence: Synthetic polypeptide
QENEIATTNPVAYAPWGNTVAGEGHLQHMNMKF

SEQ ID NO: 198719 - protein, 37 aa, Artificial Sequence
  Description of Artificial Sequence: Synthetic polypeptide
DEEEISTTNPCATEQYGQCVCSNWGEHNQENFISDQS

SEQ ID NO: 198720 - protein, 39 aa, Artificial Sequence
  Description of Artificial Sequence: Synthetic polypeptide
AEEEISTTNPVATEQYGQCVCSNWGEDHNQENFGSDNQM

SEQ ID NO: 198721 - protein, 38 aa, Artificial Sequence
  Description of Artificial Sequence: Synthetic polypeptide
DENEIRTTNPVATEQWGVVVDNGEEGEEMNAGEGIGIQ

SEQ ID NO: 198722 - protein, 35 aa, Artificial Sequence
  Description of Artificial Sequence: Synthetic polypeptide
DEQEIRTTNPIATECWGATTWANAEDWAEQKGPYI

SEQ ID NO: 198723 - protein, 37 aa, Artificial Sequence
  Description of Artificial Sequence: Synthetic polypeptide
DENEIRTTNPVATEQWGVVVDNEEGEEMNAGEGDGAT

SEQ ID NO: 198724 - protein, 38 aa, Artificial Sequence
  Description of Artificial Sequence: Synthetic polypeptide
DEEEISTTNPCATEQYGQCVCSNWGEHNAENFNSETQA

SEQ ID NO: 198725 - protein, 38 aa, Artificial Sequence
  Description of Artificial Sequence: Synthetic polypeptide
CEEEIATTNPVATAQWGCSFVANANGLPEEAPGENMKM

SEQ ID NO: 198726 - protein, 38 aa, Artificial Sequence
  Description of Artificial Sequence: Synthetic polypeptide
DEEEISTTNPCATEQYGQCVCSNWGEDNAEHFGSDTQA

SEQ ID NO: 198727 - protein, 37 aa, Artificial Sequence
  Description of Artificial Sequence: Synthetic polypeptide
DEAEIRTTNPVATEQYGCVYMLPEDVPNVPEEKPDQY

SEQ ID NO: 198728 - protein, 37 aa, Artificial Sequence
  Description of Artificial Sequence: Synthetic polypeptide
DEREISTTNPVAYEQYGCVCSNSGEHNAENFNSDTQS

SEQ ID NO: 198729 - protein, 39 aa, Artificial Sequence
  Description of Artificial Sequence: Synthetic polypeptide
AEEEISTTNPVATEQYGQCVCSNWGEDHNQENFGSENQS

SEQ ID NO: 198730 - protein, 38 aa, Artificial Sequence
  Description of Artificial Sequence: Synthetic polypeptide
AENEIACTNPVATEQYGCSCSTWGEDDNQEYFGSDNQS

SEQ ID NO: 198731 - protein, 37 aa, Artificial Sequence
  Description of Artificial Sequence: Synthetic polypeptide
CEEEISTTNPVAYEQYGCVCSMSGEHNAENFNSQNQN

SEQ ID NO: 198732 - protein, 38 aa, Artificial Sequence
  Description of Artificial Sequence: Synthetic polypeptide
DEEEISTTNPCATEQYGQCVCPTWGEHNAENFGSQTQA

SEQ ID NO: 198733 - protein, 37 aa, Artificial Sequence
  Description of Artificial Sequence: Synthetic polypeptide
DEAEISTVNPVATEGYGCVCSWGEDHNAENFGSENQA

SEQ ID NO: 198734 - protein, 39 aa, Artificial Sequence
  Description of Artificial Sequence: Synthetic polypeptide
DEEEIACTNPVAYEQYGSTVCAVTEAGGAQAQGGDNSQM

SEQ ID NO: 198735 - protein, 38 aa, Artificial Sequence
  Description of Artificial Sequence: Synthetic polypeptide
AEEEISTTNPVATEQYGQCVCSNWGEDNAENFISENQS

SEQ ID NO: 198736 - protein, 34 aa, Artificial Sequence
  Description of Artificial Sequence: Synthetic polypeptide
AEAEIASTNPVGYEAYGQCVCAYSEGLSQHVGDI

SEQ ID NO: 198737 - protein, 36 aa, Artificial Sequence
  Description of Artificial Sequence: Synthetic polypeptide
NEEEIATTNPVATEQWGGCCTAAAGNPDNMDPNAHV

SEQ ID NO: 198738 - protein, 38 aa, Artificial Sequence
  Description of Artificial Sequence: Synthetic polypeptide
DEEAISTTNPVATEQYGQCVCSMWEEHNQENFGSDTQA

SEQ ID NO: 198739 - protein, 33 aa, Artificial Sequence
  Description of Artificial Sequence: Synthetic polypeptide
EATEIATTNPVAYECWGSVYYVEATEGGQNNQG

SEQ ID NO: 198740 - protein, 38 aa, Artificial Sequence
  Description of Artificial Sequence: Synthetic polypeptide
AEEEISTTNPVATEQYGQCVCSNWGEDNAENFNSDTQS

SEQ ID NO: 198741 - protein, 38 aa, Artificial Sequence
  Description of Artificial Sequence: Synthetic polypeptide
AEEEISTTNPVATEQYGQCVCSNWGEDNAENFNSETQS

SEQ ID NO: 198742 - protein, 38 aa, Artificial Sequence
  Description of Artificial Sequence: Synthetic polypeptide
DEEAISTTNPVATEQYGQCVCSMWGEHNAEHFNSDNQI

SEQ ID NO: 198743 - protein, 36 aa, Artificial Sequence
  Description of Artificial Sequence: Synthetic polypeptide
AENEIACTNPVATEQYGCSCSNWGEDNAYFFSDNQS

SEQ ID NO: 198744 - protein, 38 aa, Artificial Sequence
  Description of Artificial Sequence: Synthetic polypeptide
DESEISTTNPVATEQYGCVCSNWEEDHNQESFNSDNQS

SEQ ID NO: 198745 - protein, 38 aa, Artificial Sequence
  Description of Artificial Sequence: Synthetic polypeptide
DECEICTTNPVATEAYGVVSTTQAQNATEQGTTTQEDE

SEQ ID NO: 198746 - protein, 38 aa, Artificial Sequence
  Description of Artificial Sequence: Synthetic polypeptide
TFEGEIAITTNPCVAYMKWGNVVSCTNMLSQQRQGNAV

SEQ ID NO: 198747 - protein, 38 aa, Artificial Sequence
  Description of Artificial Sequence: Synthetic polypeptide
DEEAISTTNPVATEQYGQCVCSNSGEHNAENFGSDTQS

SEQ ID NO: 198748 - protein, 36 aa, Artificial Sequence
  Description of Artificial Sequence: Synthetic polypeptide
CEEEIACTNPVATEQYGSACPPVDHVQTAADITAHE

SEQ ID NO: 198749 - protein, 34 aa, Artificial Sequence
  Description of Artificial Sequence: Synthetic polypeptide
TGEAEIATTNPCAYEHWGEVCYNNDDQDHGGNDH

SEQ ID NO: 198750 - protein, 34 aa, Artificial Sequence
  Description of Artificial Sequence: Synthetic polypeptide
TGEAEIATTNPCAYEHWGSVCYNNDDDDHGQNDA

SEQ ID NO: 198751 - protein, 38 aa, Artificial Sequence
  Description of Artificial Sequence: Synthetic polypeptide
DESEISTTNPVATEQYGQCVCSNWGEHNQENFNSDTQG

SEQ ID NO: 198752 - protein, 38 aa, Artificial Sequence
  Description of Artificial Sequence: Synthetic polypeptide
AEEEISTTNPVATEQYGQCVCSNWGEDNIENFNSDTQS

SEQ ID NO: 198753 - protein, 37 aa, Artificial Sequence
  Description of Artificial Sequence: Synthetic polypeptide
CEEEIACTNPVATEQYGSACSAAMPLPAEAPIGDVHQ

SEQ ID NO: 198754 - protein, 34 aa, Artificial Sequence
  Description of Artificial Sequence: Synthetic polypeptide
TEVSIAATNPVAYDPWGTVPSCTAEHSQRPGENQ

SEQ ID NO: 198755 - protein, 38 aa, Artificial Sequence
  Description of Artificial Sequence: Synthetic polypeptide
DESEIKTTNPVATDQYGSVVSDGMQGLTDGDGDIFGEQ

SEQ ID NO: 198756 - protein, 40 aa, Artificial Sequence
  Description of Artificial Sequence: Synthetic polypeptide
DECEICTTNPVATEAYGTVSVTSTQLQAGTEQGSTTTQED

SEQ ID NO: 198757 - protein, 37 aa, Artificial Sequence
  Description of Artificial Sequence: Synthetic polypeptide
DESEIKTTNPAATEFYGAVSVDNVGNIQGQEGGQEQE

SEQ ID NO: 198758 - protein, 39 aa, Artificial Sequence
  Description of Artificial Sequence: Synthetic polypeptide
DEENICTTNPVATEAYGVVTVVTVTNNLQQLQQGTDEED

SEQ ID NO: 198759 - protein, 36 aa, Artificial Sequence
  Description of Artificial Sequence: Synthetic polypeptide
DEAEIGTTNPVATEQYGCLLFTATDGYPVEFEQNKQ

SEQ ID NO: 198760 - protein, 38 aa, Artificial Sequence
  Description of Artificial Sequence: Synthetic polypeptide
DEDEIRTTNPVATDFYGAVVDGVGGIGDQALGRGNGDE

SEQ ID NO: 198761 - protein, 37 aa, Artificial Sequence
  Description of Artificial Sequence: Synthetic polypeptide
VEDEIATTNPVATEQYGSACAANPELGQDHQDDQDAE

SEQ ID NO: 198762 - protein, 38 aa, Artificial Sequence
  Description of Artificial Sequence: Synthetic polypeptide
DEEEISTTNPCATEQYGQCVCPNWEDDNQENFGSDTQA

SEQ ID NO: 198763 - protein, 37 aa, Artificial Sequence
  Description of Artificial Sequence: Synthetic polypeptide
DEEEISTTNPCATEQYGQCVCGWGEDNAENFNSDTAS

SEQ ID NO: 198764 - protein, 36 aa, Artificial Sequence
  Description of Artificial Sequence: Synthetic polypeptide
QEEEIATTNPVATEQWGGCNCAGTGQLDNEMGGVLH

SEQ ID NO: 198765 - protein, 37 aa, Artificial Sequence
  Description of Artificial Sequence: Synthetic polypeptide
DESEISTTNPVAYEQWGTVYHGENQDLQEGTQGQQQG

SEQ ID NO: 198766 - protein, 36 aa, Artificial Sequence
  Description of Artificial Sequence: Synthetic polypeptide
DEDEIATTNPVATEQWGGCCAGTGGHQIAEPQPMRN

SEQ ID NO: 198767 - protein, 38 aa, Artificial Sequence
  Description of Artificial Sequence: Synthetic polypeptide
CEEEIRTTNPVATEQYGCVCQNWGEDHNAENFNSETQA

SEQ ID NO: 198768 - protein, 33 aa, Artificial Sequence
  Description of Artificial Sequence: Synthetic polypeptide
TEVSIAATNPVAYDPWGIVPSCAAEHSQRGQNQ

SEQ ID NO: 198769 - protein, 38 aa, Artificial Sequence
  Description of Artificial Sequence: Synthetic polypeptide
DEEAISTTNPVATEQYGQCVCGSGEDHNAENFNSDTQS

SEQ ID NO: 198770 - protein, 35 aa, Artificial Sequence
  Description of Artificial Sequence: Synthetic polypeptide
NEEEIATTNPVATEQWGCNAGTGPVATMADGQAAE

SEQ ID NO: 198771 - protein, 37 aa, Artificial Sequence
  Description of Artificial Sequence: Synthetic polypeptide
DEAEISTTNPVSTEQYGCVCGNWGEHNQEGFGSQTQA

SEQ ID NO: 198772 - protein, 31 aa, Artificial Sequence
  Description of Artificial Sequence: Synthetic polypeptide
QEGEIASTNPCSYEQWGITYCLDQGSGGDTR

SEQ ID NO: 198773 - protein, 38 aa, Artificial Sequence
  Description of Artificial Sequence: Synthetic polypeptide
DEDEIRTTNPCATEQYGVVATTNANAVETGTEEGSTIG

SEQ ID NO: 198774 - protein, 37 aa, Artificial Sequence
  Description of Artificial Sequence: Synthetic polypeptide
DEECISTTNPVATEGYGCVCSNWGEHNAENFNSENQS

SEQ ID NO: 198775 - protein, 38 aa, Artificial Sequence
  Description of Artificial Sequence: Synthetic polypeptide
DEDEIRTTNPCATEQYGVVATTNANANETGTEEGTTIM

SEQ ID NO: 198776 - protein, 36 aa, Artificial Sequence
  Description of Artificial Sequence: Synthetic polypeptide
DEEEISTTNPCATEGYGCYCSWGEHNAEYFGSDTQS

SEQ ID NO: 198777 - protein, 35 aa, Artificial Sequence
  Description of Artificial Sequence: Synthetic polypeptide
DEEQIACTNPVATAPWGSFVASGHGPLGAPLGSAA

SEQ ID NO: 198778 - protein, 37 aa, Artificial Sequence
  Description of Artificial Sequence: Synthetic polypeptide
DEEEIACTNPVATEQYGSACAPANNTHGEAGMEMGDE

SEQ ID NO: 198779 - protein, 35 aa, Artificial Sequence
  Description of Artificial Sequence: Synthetic polypeptide
DSESISTTNPVAYTQWGSTVPSQPPSMNEGGNMDV

SEQ ID NO: 198780 - protein, 35 aa, Artificial Sequence
  Description of Artificial Sequence: Synthetic polypeptide
SAEEIATTNPVAYEQWGCNTAGNGLTEAEGGNMDD

SEQ ID NO: 198781 - protein, 36 aa, Artificial Sequence
  Description of Artificial Sequence: Synthetic polypeptide
DEEEISTTNPCATEEYGCVCQWGEHNAENFGSDTQA

SEQ ID NO: 198782 - protein, 35 aa, Artificial Sequence
  Description of Artificial Sequence: Synthetic polypeptide
DESEIRTTNPVSTECWGCIAPEDGQQQHQQRGTVS

SEQ ID NO: 198783 - protein, 36 aa, Artificial Sequence
  Description of Artificial Sequence: Synthetic polypeptide
DEEQIACTNPVATAAWGSVANSGHGPLGAPGGNFHQ

SEQ ID NO: 198784 - protein, 40 aa, Artificial Sequence
  Description of Artificial Sequence: Synthetic polypeptide
DEEEIRTTNPVATEQYGQCQVCSNWEEDHNAENFNSDNQA

SEQ ID NO: 198785 - protein, 40 aa, Artificial Sequence
  Description of Artificial Sequence: Synthetic polypeptide
DEEEIRTTNPVATEQYGQCQVCSNWGEDHNIENFNSDNQS

SEQ ID NO: 198786 - protein, 35 aa, Artificial Sequence
  Description of Artificial Sequence: Synthetic polypeptide
AEEEIASVNPVCTEQYGCVCSWGNHNQESFISDQA

SEQ ID NO: 198787 - protein, 34 aa, Artificial Sequence
  Description of Artificial Sequence: Synthetic polypeptide
DSEVISCTNPVAYTPWGSTVPSQPPSMRGGNMDV

SEQ ID NO: 198788 - protein, 36 aa, Artificial Sequence
  Description of Artificial Sequence: Synthetic polypeptide
SAEEIATTNPVAYEQWGPCNTAGNGLTTAEGGNMDT

SEQ ID NO: 198789 - protein, 34 aa, Artificial Sequence
  Description of Artificial Sequence: Synthetic polypeptide
DSFEIATTNPVAYDPDGHTVASCPNHSTIGGNDH

SEQ ID NO: 198790 - protein, 36 aa, Artificial Sequence
  Description of Artificial Sequence: Synthetic polypeptide
AEEEIASVNPVCTEQYGCVCSWGELNQESFNSQTQA

SEQ ID NO: 198791 - protein, 36 aa, Artificial Sequence
  Description of Artificial Sequence: Synthetic polypeptide
AEEEIASVNPVCTEQYGCVCSWGEHNAENFGSDNQA

SEQ ID NO: 198792 - protein, 40 aa, Artificial Sequence
  Description of Artificial Sequence: Synthetic polypeptide
DEEEIRTTNPVATEQYGQCQVCSNWGEDHNAENFNSDNQS

SEQ ID NO: 198793 - protein, 37 aa, Artificial Sequence
  Description of Artificial Sequence: Synthetic polypeptide
DEEEISTTNPCATEQYGCVCGNWEEHNAEYFGSDTAS

SEQ ID NO: 198794 - protein, 37 aa, Artificial Sequence
  Description of Artificial Sequence: Synthetic polypeptide
ESEAEIRTTNPVAYEQWGVVYQWGTNPQPGEKGDGST

SEQ ID NO: 198795 - protein, 40 aa, Artificial Sequence
  Description of Artificial Sequence: Synthetic polypeptide
DEEEIRTTNPVATEQYGQCAVCSNWGEDHNAENFGSETQP

SEQ ID NO: 198796 - protein, 38 aa, Artificial Sequence
  Description of Artificial Sequence: Synthetic polypeptide
DECEICTTNPVATEAYGVVVVTQLQAGTEQGSTTTQED

SEQ ID NO: 198797 - protein, 36 aa, Artificial Sequence
  Description of Artificial Sequence: Synthetic polypeptide
NEEEIATTNPVAYEQWGHCVAGTGLPADTPGDEAAD

SEQ ID NO: 198798 - protein, 34 aa, Artificial Sequence
  Description of Artificial Sequence: Synthetic polypeptide
CENEIATTNPVAYEPWGQKVSIMHLSQQHETELY

SEQ ID NO: 198799 - protein, 37 aa, Artificial Sequence
  Description of Artificial Sequence: Synthetic polypeptide
DEEEISTTNPCATEQYGCVCPMWMEHNAENFGSDTQA

SEQ ID NO: 198800 - protein, 36 aa, Artificial Sequence
  Description of Artificial Sequence: Synthetic polypeptide
DEEEISTTNPCATEQYGCVCGWMEHNAENFISDTAS

SEQ ID NO: 198801 - protein, 38 aa, Artificial Sequence
  Description of Artificial Sequence: Synthetic polypeptide
DEEEIACTNPVATEQYGSACAIINPDEEAGAHQDNDAP

SEQ ID NO: 198802 - protein, 38 aa, Artificial Sequence
  Description of Artificial Sequence: Synthetic polypeptide
DDEEISTTNPVAYEQYGCVCSTWGEDHNAENFNSDTQS

SEQ ID NO: 198803 - protein, 37 aa, Artificial Sequence
  Description of Artificial Sequence: Synthetic polypeptide
DDEEISTTNPVAYEQYGCVCSNWGEHNAENFNSDTQF

SEQ ID NO: 198804 - protein, 37 aa, Artificial Sequence
  Description of Artificial Sequence: Synthetic polypeptide
DDEEISTTNPVAYEQYGCVCSNWGEHNAEGFNSDTQA

SEQ ID NO: 198805 - protein, 35 aa, Artificial Sequence
  Description of Artificial Sequence: Synthetic polypeptide
DEQDEIATTNPVAYERWGSVCGQNPGNAGEHDGQD

SEQ ID NO: 198806 - protein, 36 aa, Artificial Sequence
  Description of Artificial Sequence: Synthetic polypeptide
DAEEIATTNPVAYEQWGCNTAGNNGLTTAENGNSDS

SEQ ID NO: 198807 - protein, 39 aa, Artificial Sequence
  Description of Artificial Sequence: Synthetic polypeptide
SEEEICTTNPVATEQYGQSTCGSVAEMIENQEETQELNL

SEQ ID NO: 198808 - protein, 37 aa, Artificial Sequence
  Description of Artificial Sequence: Synthetic polypeptide
QEDEIATTNPVATEQYGCISFSSPDTLREPHEWEDTR

SEQ ID NO: 198809 - protein, 37 aa, Artificial Sequence
  Description of Artificial Sequence: Synthetic polypeptide
DEQEAEIRTTNPVAYEPWGVAATGDNDRPGERQDNSV

SEQ ID NO: 198810 - protein, 37 aa, Artificial Sequence
  Description of Artificial Sequence: Synthetic polypeptide
CEEEIACTNPVATAQWGCIVAMTNSLTNPDDGMGNQM

SEQ ID NO: 198811 - protein, 38 aa, Artificial Sequence
  Description of Artificial Sequence: Synthetic polypeptide
SAEEIATTNPVATEQYGSVCSVANPGAGEATGGDLAAM

SEQ ID NO: 198812 - protein, 38 aa, Artificial Sequence
  Description of Artificial Sequence: Synthetic polypeptide
SAEEIATTNPVATEQYGSVCTPANPANGIDHADDTKAH

SEQ ID NO: 198813 - protein, 35 aa, Artificial Sequence
  Description of Artificial Sequence: Synthetic polypeptide
DSFEIATTNPVAYDPDGHTVASCSNHSIIGGNDRE

SEQ ID NO: 198814 - protein, 35 aa, Artificial Sequence
  Description of Artificial Sequence: Synthetic polypeptide
DSGEICTTNPCAYERYGSVVCSEVMGSQNTGMTQI

SEQ ID NO: 198815 - protein, 34 aa, Artificial Sequence
  Description of Artificial Sequence: Synthetic polypeptide
AEEEIASVNPVCTEQYGCVCSWGEDNQSFISDQA

SEQ ID NO: 198816 - protein, 36 aa, Artificial Sequence
  Description of Artificial Sequence: Synthetic polypeptide
AEEEIASVNPVCTEQYGCVCSWGEDLNQESFGSDQA

SEQ ID NO: 198817 - protein, 36 aa, Artificial Sequence
  Description of Artificial Sequence: Synthetic polypeptide
AEEEIASVNPVCTEQYGCVCSTWGEHNQESFGSQQA

SEQ ID NO: 198818 - protein, 37 aa, Artificial Sequence
  Description of Artificial Sequence: Synthetic polypeptide
DDEEISTTNPVAYEQYGCVCSNSGEDNAENFNSETQA

SEQ ID NO: 198819 - protein, 37 aa, Artificial Sequence
  Description of Artificial Sequence: Synthetic polypeptide
DDEEISTTNPVAYEQYGCVCSMWGEHNQEHFNSDTQA

SEQ ID NO: 198820 - protein, 38 aa, Artificial Sequence
  Description of Artificial Sequence: Synthetic polypeptide
AEEEISTTNPVATEQYGQCVCSNWGEHNAENFGSDTQS

SEQ ID NO: 198821 - protein, 37 aa, Artificial Sequence
  Description of Artificial Sequence: Synthetic polypeptide
DDEEISTTNPVAYEQYGCVCSMWGEHNAENFNSDNQS

SEQ ID NO: 198822 - protein, 35 aa, Artificial Sequence
  Description of Artificial Sequence: Synthetic polypeptide
CEEEIACTNPVATAQWGHAASLANMGQAEDPNENN

SEQ ID NO: 198823 - protein, 35 aa, Artificial Sequence
  Description of Artificial Sequence: Synthetic polypeptide
AEEEIASVNPVCTEQYGCVCSSGEHNQSFNSDTQS

SEQ ID NO: 198824 - protein, 38 aa, Artificial Sequence
  Description of Artificial Sequence: Synthetic polypeptide
DEDEIATTNPVATEQWGGCTTAGNNGENNDMLPDGMNP

SEQ ID NO: 198825 - protein, 37 aa, Artificial Sequence
  Description of Artificial Sequence: Synthetic polypeptide
AEECINTTNPVAYERYGISVFCEQSSHSQTDLGDNLY

SEQ ID NO: 198826 - protein, 38 aa, Artificial Sequence
  Description of Artificial Sequence: Synthetic polypeptide
AEEEISTTNPVATEQYGQCVCSNWGEHNAENFGSETQF

SEQ ID NO: 198827 - protein, 37 aa, Artificial Sequence
  Description of Artificial Sequence: Synthetic polypeptide
DEMEISTTNPVAYEQYGCVCSNWGEHNAEYFNSDTQS

SEQ ID NO: 198828 - protein, 37 aa, Artificial Sequence
  Description of Artificial Sequence: Synthetic polypeptide
DEMEISTTNPVAYEQYGCVCSNWGEPNAENFNSDTQA

SEQ ID NO: 198829 - protein, 39 aa, Artificial Sequence
  Description of Artificial Sequence: Synthetic polypeptide
FEEEIRTTNPAATEQYGSVVVAGVNDNFNVGQGEFNEID

SEQ ID NO: 198830 - protein, 34 aa, Artificial Sequence
  Description of Artificial Sequence: Synthetic polypeptide
CEEEIACTNPVATAQWGHSASLAGAGQAEDPLEN

SEQ ID NO: 198831 - protein, 36 aa, Artificial Sequence
  Description of Artificial Sequence: Synthetic polypeptide
DENEIATTNPVATEQWGCVAGENGVEMNAASEDNAE

SEQ ID NO: 198832 - protein, 38 aa, Artificial Sequence
  Description of Artificial Sequence: Synthetic polypeptide
DDEAIRTTNPVATEQWGQCVTSNWGEDNQENFGSDNAS

SEQ ID NO: 198833 - protein, 39 aa, Artificial Sequence
  Description of Artificial Sequence: Synthetic polypeptide
DEEEIRTTNPVATEFYGEVVNMQGPNNMDNQEGEDTEEG

SEQ ID NO: 198834 - protein, 35 aa, Artificial Sequence
  Description of Artificial Sequence: Synthetic polypeptide
AEAEIASTNPVGTEGYGVSCGSGEHNQHFGSDNQS

SEQ ID NO: 198835 - protein, 36 aa, Artificial Sequence
  Description of Artificial Sequence: Synthetic polypeptide
DEAEEATTNPVAYEPWGVVVHTDQGQQDDRHGGGER

SEQ ID NO: 198836 - protein, 38 aa, Artificial Sequence
  Description of Artificial Sequence: Synthetic polypeptide
DDEEISTTNPVAYEQYGCVCSNWGEDHNAENFGSDNQS

SEQ ID NO: 198837 - protein, 37 aa, Artificial Sequence
  Description of Artificial Sequence: Synthetic polypeptide
DENEIRTTNPVATEQWGDVDNGEEGEEMNDGEGDGEN

SEQ ID NO: 198838 - protein, 37 aa, Artificial Sequence
  Description of Artificial Sequence: Synthetic polypeptide
DENEIRTTNPVATEEYGACCWVADLDVEQLEGGEDHL

SEQ ID NO: 198839 - protein, 36 aa, Artificial Sequence
  Description of Artificial Sequence: Synthetic polypeptide
DSGEICTTNPVAYERYGSVVCSAQVMGSQNTGMTQI

SEQ ID NO: 198840 - protein, 36 aa, Artificial Sequence
  Description of Artificial Sequence: Synthetic polypeptide
DEEEISTTNPCATEEYGCVCQNWEHNAENFNSDTAA

SEQ ID NO: 198841 - protein, 38 aa, Artificial Sequence
  Description of Artificial Sequence: Synthetic polypeptide
AEEEISTTNPVATEQYGQCVCSNWGEHNAENFFSDNQA

SEQ ID NO: 198842 - protein, 36 aa, Artificial Sequence
  Description of Artificial Sequence: Synthetic polypeptide
SAEEIATTNPVAYEQYGSVCAGNGGDEATAGEGVSD

SEQ ID NO: 198843 - protein, 36 aa, Artificial Sequence
  Description of Artificial Sequence: Synthetic polypeptide
SAEEIATTNPVAYEQYGSVCAMNNGGEPAIGGGEMG

SEQ ID NO: 198844 - protein, 37 aa, Artificial Sequence
  Description of Artificial Sequence: Synthetic polypeptide
SAEEIATTNPVAYEQYGSVCSMANPAGEATGDDLAVM

SEQ ID NO: 198845 - protein, 37 aa, Artificial Sequence
  Description of Artificial Sequence: Synthetic polypeptide
DEECISTTNPVATEGYGCVCGTGEADNQEYFGSDTQA

SEQ ID NO: 198846 - protein, 34 aa, Artificial Sequence
  Description of Artificial Sequence: Synthetic polypeptide
ESSEIATTNPVAYDPDGHTVASCPNHSSIGGNDR

SEQ ID NO: 198847 - protein, 36 aa, Artificial Sequence
  Description of Artificial Sequence: Synthetic polypeptide
DESEIATTNPVAYEPQWGCNIAGNNGLADQESGYDN

SEQ ID NO: 198848 - protein, 35 aa, Artificial Sequence
  Description of Artificial Sequence: Synthetic polypeptide
VEDEIATTNPVATEQWGCTAGNPHLEATMDIDQRM

SEQ ID NO: 198849 - protein, 37 aa, Artificial Sequence
  Description of Artificial Sequence: Synthetic polypeptide
DEMEISTTNPVAYEQYGCVCSNWGEDNAEFFNSDTQA

SEQ ID NO: 198850 - protein, 37 aa, Artificial Sequence
  Description of Artificial Sequence: Synthetic polypeptide
SAEEIATTNPVAYEQYGSVCSPVDNNHNIDAMGEGAG

SEQ ID NO: 198851 - protein, 38 aa, Artificial Sequence
  Description of Artificial Sequence: Synthetic polypeptide
DDEEISTTNPVAYEQYGCVCSNWGEDHNAENFQSDNQS

SEQ ID NO: 198852 - protein, 37 aa, Artificial Sequence
  Description of Artificial Sequence: Synthetic polypeptide
DEMEISTTNPVAYEQYGCVCSNWGEHNAENFGSDTQA

SEQ ID NO: 198853 - protein, 34 aa, Artificial Sequence
  Description of Artificial Sequence: Synthetic polypeptide
VEDEIATTNPVATEQWGCTAGNGHDEATMDIDRM

SEQ ID NO: 198854 - protein, 37 aa, Artificial Sequence
  Description of Artificial Sequence: Synthetic polypeptide
DEEEISCTNPVAYEQYGQCVCSWGEHNAENFNSETQA

SEQ ID NO: 198855 - protein, 34 aa, Artificial Sequence
  Description of Artificial Sequence: Synthetic polypeptide
VEDEIATTNPVATEQWGCTAGNEHLEATMDIDEH

SEQ ID NO: 198856 - protein, 35 aa, Artificial Sequence
  Description of Artificial Sequence: Synthetic polypeptide
DESEIRTTNPVSTEPWGCIAPEDAQQQQQQQGTNS

SEQ ID NO: 198857 - protein, 37 aa, Artificial Sequence
  Description of Artificial Sequence: Synthetic polypeptide
DEAVIATTNPVAYEQWGETVCPINDLHDQDQGNNHVL

SEQ ID NO: 198858 - protein, 36 aa, Artificial Sequence
  Description of Artificial Sequence: Synthetic polypeptide
DEECISTTNPVATEGYGCVCQWGEAHNQYFNSDTQS

SEQ ID NO: 198859 - protein, 38 aa, Artificial Sequence
  Description of Artificial Sequence: Synthetic polypeptide
DENEIRTTNPVATEQWGQCVTSNWMEHNTENFISDTAS

SEQ ID NO: 198860 - protein, 37 aa, Artificial Sequence
  Description of Artificial Sequence: Synthetic polypeptide
DENEIRTTNPVATEQWGQCVCSSMPENANNFISDTAA

SEQ ID NO: 198861 - protein, 37 aa, Artificial Sequence
  Description of Artificial Sequence: Synthetic polypeptide
CEECISTTNPVATEQYGQCVCSWGEHNAENFGSETQS

SEQ ID NO: 198862 - protein, 32 aa, Artificial Sequence
  Description of Artificial Sequence: Synthetic polypeptide
QEGEIASTNPCSYEQWGCTYCLDQSQGDTNRQ

SEQ ID NO: 198863 - protein, 38 aa, Artificial Sequence
  Description of Artificial Sequence: Synthetic polypeptide
AEEEISTTNPVATEQYGQCVCSNWGEHNAEGFNSDTQA

SEQ ID NO: 198864 - protein, 36 aa, Artificial Sequence
  Description of Artificial Sequence: Synthetic polypeptide
DSEEIRTTNPVGYETWGCVRHNNDKQQDQRGGDAGK

SEQ ID NO: 198865 - protein, 38 aa, Artificial Sequence
  Description of Artificial Sequence: Synthetic polypeptide
DEEEIRCTNPVATEQYGCVCSMWGEDDNQENFISQTQS

SEQ ID NO: 198866 - protein, 38 aa, Artificial Sequence
  Description of Artificial Sequence: Synthetic polypeptide
AEEEISTTNPVATEQYGQCVCSNWGEHNAEHFNSDTQS

SEQ ID NO: 198867 - protein, 37 aa, Artificial Sequence
  Description of Artificial Sequence: Synthetic polypeptide
SAEEIATTNPVATEQYGSVCAANNGPEADMPGGLMWH

SEQ ID NO: 198868 - protein, 38 aa, Artificial Sequence
  Description of Artificial Sequence: Synthetic polypeptide
AEEEISTTNPVATEQYGQCVCSNWGEHNAEHFNSENQS

SEQ ID NO: 198869 - protein, 37 aa, Artificial Sequence
  Description of Artificial Sequence: Synthetic polypeptide
SAEEIATTNPVATEQYGSVCAHNSVEGAGADIDISDM

SEQ ID NO: 198870 - protein, 37 aa, Artificial Sequence
  Description of Artificial Sequence: Synthetic polypeptide
CEECISTTNPVATEQYGQCVCSWGEHNTEHFNSDTQA

SEQ ID NO: 198871 - protein, 36 aa, Artificial Sequence
  Description of Artificial Sequence: Synthetic polypeptide
DENAIATVNPVATECYGSVVCIDHQDQERQGDTEMK

SEQ ID NO: 198872 - protein, 36 aa, Artificial Sequence
  Description of Artificial Sequence: Synthetic polypeptide
ESEAEIRTTNPVAYEQWGVVYQWGTNPPGEKGDGMS

SEQ ID NO: 198873 - protein, 36 aa, Artificial Sequence
  Description of Artificial Sequence: Synthetic polypeptide
DEQCEIATTNPVAYEQWGSVVCNAAMPREDIEDDSM

SEQ ID NO: 198874 - protein, 36 aa, Artificial Sequence
  Description of Artificial Sequence: Synthetic polypeptide
DENEIRTTNPVATEQWGDTVIGVIEQMIAVEVDPTW

SEQ ID NO: 198875 - protein, 37 aa, Artificial Sequence
  Description of Artificial Sequence: Synthetic polypeptide
DDEEISTTNPVGTEQWGQCVCSWGEDNAENFGSVNQS

SEQ ID NO: 198876 - protein, 36 aa, Artificial Sequence
  Description of Artificial Sequence: Synthetic polypeptide
DEAEICTTNPVAYEQYQSLPNPNVDMMNFQSMQDEW

SEQ ID NO: 198877 - protein, 36 aa, Artificial Sequence
  Description of Artificial Sequence: Synthetic polypeptide
DEEEIACTNPVAYEQWGGCNVAGTGQDDNQMGGEKH

SEQ ID NO: 198878 - protein, 37 aa, Artificial Sequence
  Description of Artificial Sequence: Synthetic polypeptide
FEEEIRTTNPVATEFYGVVNMGINNMDNFTGEFTEEG

SEQ ID NO: 198879 - protein, 35 aa, Artificial Sequence
  Description of Artificial Sequence: Synthetic polypeptide
DSEEIRTTNPVGYEHWGCVRHNNDKQNDRRLEDMM

SEQ ID NO: 198880 - protein, 37 aa, Artificial Sequence
  Description of Artificial Sequence: Synthetic polypeptide
DEEEIACTNPVAYEQWGSVAACPGNPLATETNDGSVG

SEQ ID NO: 198881 - protein, 37 aa, Artificial Sequence
  Description of Artificial Sequence: Synthetic polypeptide
DDEEIACTNPVATEQYGCVCSNWGEHNQENSNSQTQA

SEQ ID NO: 198882 - protein, 35 aa, Artificial Sequence
  Description of Artificial Sequence: Synthetic polypeptide
CEEEIACTNPVATEQWGCVAGTGEDTTDSGGSTEE

SEQ ID NO: 198883 - protein, 38 aa, Artificial Sequence
  Description of Artificial Sequence: Synthetic polypeptide
DEDEIRTTNPCATEQYGVVATTNANANDTGTEEGSTGD

SEQ ID NO: 198884 - protein, 36 aa, Artificial Sequence
  Description of Artificial Sequence: Synthetic polypeptide
DEECIATTNPVATEGYGCVCGWGEDDNQEYFNSDQS

SEQ ID NO: 198885 - protein, 37 aa, Artificial Sequence
  Description of Artificial Sequence: Synthetic polypeptide
DEECISTTNPVATEGYGCVCSNWGEHNAENFNSENQA

SEQ ID NO: 198886 - protein, 32 aa, Artificial Sequence
  Description of Artificial Sequence: Synthetic polypeptide
QEGEIASTNPCSYEQWGITCYCNDNQQGDTAR

SEQ ID NO: 198887 - protein, 37 aa, Artificial Sequence
  Description of Artificial Sequence: Synthetic polypeptide
DEECISTTNPVATEGYGCVCSNWGEHNAENFNSDNQS

SEQ ID NO: 198888 - protein, 34 aa, Artificial Sequence
  Description of Artificial Sequence: Synthetic polypeptide
AECENATTNPVAYEFWGVVATGGNTGNAGNDNQP

SEQ ID NO: 198889 - protein, 35 aa, Artificial Sequence
  Description of Artificial Sequence: Synthetic polypeptide
QEEEIRTTNPIATECWGATTWANAEDWQEPKGPYI

SEQ ID NO: 198890 - protein, 32 aa, Artificial Sequence
  Description of Artificial Sequence: Synthetic polypeptide
QEGEIASTNPCSYEQWGITCYCNDNQDSGDTR

SEQ ID NO: 198891 - protein, 38 aa, Artificial Sequence
  Description of Artificial Sequence: Synthetic polypeptide
DEECIATTNPVATEQYGQCVCSNSGEHNQENFNSDNQL

SEQ ID NO: 198892 - protein, 32 aa, Artificial Sequence
  Description of Artificial Sequence: Synthetic polypeptide
QEGEIASTNPCSYEQWGITCYCNDGQSGDTRR

SEQ ID NO: 198893 - protein, 36 aa, Artificial Sequence
  Description of Artificial Sequence: Synthetic polypeptide
SAEEIATTNPVATEQYGSVCAAGPLGFATMSDEEGD

SEQ ID NO: 198894 - protein, 37 aa, Artificial Sequence
  Description of Artificial Sequence: Synthetic polypeptide
DENEIRTTNPVATEQWGQVDIGEEGEEMNAGEGDGET

SEQ ID NO: 198895 - protein, 32 aa, Artificial Sequence
  Description of Artificial Sequence: Synthetic polypeptide
QEGEIASTNPCSYEQWGITAYCNDQGSGDTGR

SEQ ID NO: 198896 - protein, 35 aa, Artificial Sequence
  Description of Artificial Sequence: Synthetic polypeptide
DSEEIRTTNPVGYEHWGCVRHNNDKQHDRRPEDMT

SEQ ID NO: 198897 - protein, 38 aa, Artificial Sequence
  Description of Artificial Sequence: Synthetic polypeptide
DEMCISTTNPVATEQYGQCICSNWGETNQEYFGSDNQS

SEQ ID NO: 198898 - protein, 38 aa, Artificial Sequence
  Description of Artificial Sequence: Synthetic polypeptide
CEEEIRTTNPVATEQYGCVCSNWGEDHNAENFISETQS

SEQ ID NO: 198899 - protein, 37 aa, Artificial Sequence
  Description of Artificial Sequence: Synthetic polypeptide
DDEEISTTNPVGTEQWGCVCSNWGEHNAENFGSDNQS

SEQ ID NO: 198900 - protein, 38 aa, Artificial Sequence
  Description of Artificial Sequence: Synthetic polypeptide
DDEEIRTTNPVATDAYGSVLGNNANGGEEDNEGGNNTV

SEQ ID NO: 198901 - protein, 36 aa, Artificial Sequence
  Description of Artificial Sequence: Synthetic polypeptide
TNNEIATTNPVATECYGCVCPTLNDNQDQDGQQGDI

SEQ ID NO: 198902 - protein, 37 aa, Artificial Sequence
  Description of Artificial Sequence: Synthetic polypeptide
DDEEIRCTNPVGTEQWGCVCSNWGEHNQENFGSVNQS

SEQ ID NO: 198903 - protein, 36 aa, Artificial Sequence
  Description of Artificial Sequence: Synthetic polypeptide
TNQEIATTNPVAYEQWGSCVQNGGNAGEDLKREGDP

SEQ ID NO: 198904 - protein, 39 aa, Artificial Sequence
  Description of Artificial Sequence: Synthetic polypeptide
DECEICTTNPVATEAYGVVVVSTQLQAGTEQGSTTQQED

SEQ ID NO: 198905 - protein, 37 aa, Artificial Sequence
  Description of Artificial Sequence: Synthetic polypeptide
TNQEISTTNPVAYEQWGWVSTINQGADQGQTGRGGQG

SEQ ID NO: 198906 - protein, 36 aa, Artificial Sequence
  Description of Artificial Sequence: Synthetic polypeptide
DEAVIATTNPVAYEQWGETVCPINDFHDQDGQNHNH

SEQ ID NO: 198907 - protein, 37 aa, Artificial Sequence
  Description of Artificial Sequence: Synthetic polypeptide
DEMEIRTTNPVATEGWGQCVCSWGEENAEYFNSQTQS

SEQ ID NO: 198908 - protein, 38 aa, Artificial Sequence
  Description of Artificial Sequence: Synthetic polypeptide
DENEIRTTNPVATEQWGQCVCSNSGEDNAEHSNSDTAS

SEQ ID NO: 198909 - protein, 34 aa, Artificial Sequence
  Description of Artificial Sequence: Synthetic polypeptide
DESEIRTTNPVSTEPWGCIAPEDGQQQQQQRTGS

SEQ ID NO: 198910 - protein, 38 aa, Artificial Sequence
  Description of Artificial Sequence: Synthetic polypeptide
DDEEISTTNPVATEQYGCVCSNSGEDHNAEYFNSDTQS

SEQ ID NO: 198911 - protein, 35 aa, Artificial Sequence
  Description of Artificial Sequence: Synthetic polypeptide
DESEIRTTNPVSTEPWGCIAPEDGQQQQQNRGTES

SEQ ID NO: 198912 - protein, 35 aa, Artificial Sequence
  Description of Artificial Sequence: Synthetic polypeptide
DESEIRTTNPVSTEPWGCIAPEDGQQQHQQRSTNS

SEQ ID NO: 198913 - protein, 38 aa, Artificial Sequence
  Description of Artificial Sequence: Synthetic polypeptide
NEEEISTTNPVATEQYGQCVCSNWGEHNDEYFNSDTQS

SEQ ID NO: 198914 - protein, 34 aa, Artificial Sequence
  Description of Artificial Sequence: Synthetic polypeptide
DSEEISCTNPVAYTAWGSTVPPQPPSMRGGNMDV

SEQ ID NO: 198915 - protein, 36 aa, Artificial Sequence
  Description of Artificial Sequence: Synthetic polypeptide
DSEEISCTNPVAYTQWGSTVPSQPEPSMTRGGNMDV

SEQ ID NO: 198916 - protein, 39 aa, Artificial Sequence
  Description of Artificial Sequence: Synthetic polypeptide
DEEEIRSTNPVATDQYGMVSVEMGMGDGGQGQENQERGQ

SEQ ID NO: 198917 - protein, 40 aa, Artificial Sequence
  Description of Artificial Sequence: Synthetic polypeptide
DEEEIRSTNPAATEQYGSVYDPEATTDNGEINEGGQGNGD

SEQ ID NO: 198918 - protein, 37 aa, Artificial Sequence
  Description of Artificial Sequence: Synthetic polypeptide
DEECISTTNPVATEGYGCVCSNWEEHNQENFNSQNQS

SEQ ID NO: 198919 - protein, 38 aa, Artificial Sequence
  Description of Artificial Sequence: Synthetic polypeptide
DDEEIRCTNPVATEQYGSVYGQGQGDDEFGTGGQEETD

SEQ ID NO: 198920 - protein, 37 aa, Artificial Sequence
  Description of Artificial Sequence: Synthetic polypeptide
SAEEIATTNPVATEQYGSVCAMANHADSKAPADNVNN

SEQ ID NO: 198921 - protein, 36 aa, Artificial Sequence
  Description of Artificial Sequence: Synthetic polypeptide
DESEIRTTNPVSTEPWGCIAPEDPQQQQQQRSGTNS

SEQ ID NO: 198922 - protein, 35 aa, Artificial Sequence
  Description of Artificial Sequence: Synthetic polypeptide
DESEIRTTNPVSTEPWGCIAPEDRQQQQQQPGTNT

SEQ ID NO: 198923 - protein, 39 aa, Artificial Sequence
  Description of Artificial Sequence: Synthetic polypeptide
DECEICTTNPVATEAYGVVVTSTQLQAGTEQGSTQTQED

SEQ ID NO: 198924 - protein, 38 aa, Artificial Sequence
  Description of Artificial Sequence: Synthetic polypeptide
DDEEIRTTNPVATDAYGSVIGNNMNGGEEMNEGGGNTD

SEQ ID NO: 198925 - protein, 36 aa, Artificial Sequence
  Description of Artificial Sequence: Synthetic polypeptide
DEAEEATTNPVAYEPWGVVVHTDQGLQDDRKGGQEH

SEQ ID NO: 198926 - protein, 37 aa, Artificial Sequence
  Description of Artificial Sequence: Synthetic polypeptide
CEEEIACTNPVATEQYGSACPNNPDEEAGAHQDGEAP

SEQ ID NO: 198927 - protein, 35 aa, Artificial Sequence
  Description of Artificial Sequence: Synthetic polypeptide
DESEIRTTNPVSTEPWGCIAPEDQQQQQQRDGTAN

SEQ ID NO: 198928 - protein, 35 aa, Artificial Sequence
  Description of Artificial Sequence: Synthetic polypeptide
AEEEIASVNPVCTEQYGQCVCSWGEHNQSFGSQQA

SEQ ID NO: 198929 - protein, 35 aa, Artificial Sequence
  Description of Artificial Sequence: Synthetic polypeptide
DESEIRTTNPVSTEPWGCIAPEDQQQQQQQGVTNP

SEQ ID NO: 198930 - protein, 39 aa, Artificial Sequence
  Description of Artificial Sequence: Synthetic polypeptide
DDEEIRTTNPVATDAYGAVSIDTLNNDLGTEGEGQQEET

SEQ ID NO: 198931 - protein, 34 aa, Artificial Sequence
  Description of Artificial Sequence: Synthetic polypeptide
DESEIRTTNPVSTEPWGCIAPEDQQQQQQQGIGP

SEQ ID NO: 198932 - protein, 38 aa, Artificial Sequence
  Description of Artificial Sequence: Synthetic polypeptide
DDEEISTTNPVATEQYGCVCSNSEEDDNAENFNSDTQS

SEQ ID NO: 198933 - protein, 38 aa, Artificial Sequence
  Description of Artificial Sequence: Synthetic polypeptide
CEEEIACTNPVATEQYGSACNPTPDGLPLAAGEGMNQD

SEQ ID NO: 198934 - protein, 38 aa, Artificial Sequence
  Description of Artificial Sequence: Synthetic polypeptide
DEREISTTNPVATEQYGQCVCSWPEDHNQENFNSDTQS

SEQ ID NO: 198935 - protein, 37 aa, Artificial Sequence
  Description of Artificial Sequence: Synthetic polypeptide
DDEEIRTTNPVATDAYGAVIGNNNGGEEDNEDGNNTV

SEQ ID NO: 198936 - protein, 38 aa, Artificial Sequence
  Description of Artificial Sequence: Synthetic polypeptide
DDEEIRTTNPVATCQYGQCVCSNWEEDHNQENFNSDQS

SEQ ID NO: 198937 - protein, 36 aa, Artificial Sequence
  Description of Artificial Sequence: Synthetic polypeptide
TNGEIATTNPVATEAYGCVCPTNDNQQDQDQQQNQD

SEQ ID NO: 198938 - protein, 38 aa, Artificial Sequence
  Description of Artificial Sequence: Synthetic polypeptide
TNGTEIATTNPVAYEQWGSVSHTQNGLDQGGPGDGDFS

SEQ ID NO: 198939 - protein, 30 aa, Artificial Sequence
  Description of Artificial Sequence: Synthetic polypeptide
QEGEIASTNPCSYEAWGITCYCNDQSGDTH

SEQ ID NO: 198940 - protein, 37 aa, Artificial Sequence
  Description of Artificial Sequence: Synthetic polypeptide
DENEIRTTNPVATEFYGMVSVEGMGDDGQGQEAQEGT

SEQ ID NO: 198941 - protein, 38 aa, Artificial Sequence
  Description of Artificial Sequence: Synthetic polypeptide
DEAEIGTTNPVATEQYGQCVCSWGEDHNAENFNSETQS

SEQ ID NO: 198942 - protein, 37 aa, Artificial Sequence
  Description of Artificial Sequence: Synthetic polypeptide
QEEEICTTNPVATEQYGVVAGPGEGEGGQGGGEEDTH

SEQ ID NO: 198943 - protein, 33 aa, Artificial Sequence
  Description of Artificial Sequence: Synthetic polypeptide
DESEIRSTNPIATEGWGATTWANADWASPKGPI

SEQ ID NO: 198944 - protein, 36 aa, Artificial Sequence
  Description of Artificial Sequence: Synthetic polypeptide
DESTICTTNPVATEFYGQTVVNDINGLEIGGDDDED

SEQ ID NO: 198945 - protein, 33 aa, Artificial Sequence
  Description of Artificial Sequence: Synthetic polypeptide
DESEIRSTNPIATEGWGATTWANADWAEPKGPI

SEQ ID NO: 198946 - protein, 37 aa, Artificial Sequence
  Description of Artificial Sequence: Synthetic polypeptide
DEECISTTNPVATEIYGCVCGNWGEDNQENFNSDTQS

SEQ ID NO: 198947 - protein, 33 aa, Artificial Sequence
  Description of Artificial Sequence: Synthetic polypeptide
DEEAIRTTNPVAYEEWGYCTIDGGDHDRNMDAA

SEQ ID NO: 198948 - protein, 34 aa, Artificial Sequence
  Description of Artificial Sequence: Synthetic polypeptide
DEEAIRTTNPVAYEEWGYCTIDGGDHMRGMDAAD

SEQ ID NO: 198949 - protein, 38 aa, Artificial Sequence
  Description of Artificial Sequence: Synthetic polypeptide
DEEAIRTTNPVAYEQYGQCVCSNSGEHNIENFNSDTQA

SEQ ID NO: 198950 - protein, 33 aa, Artificial Sequence
  Description of Artificial Sequence: Synthetic polypeptide
DESEIRSTNPIATEGWGATWANSDWAEPKGPYI

SEQ ID NO: 198951 - protein, 39 aa, Artificial Sequence
  Description of Artificial Sequence: Synthetic polypeptide
DEEEIRTTNPCATEAYGVVSVVVVNTQAGTTEQGTVTDE

SEQ ID NO: 198952 - protein, 39 aa, Artificial Sequence
  Description of Artificial Sequence: Synthetic polypeptide
DEEAIRTTNPVAYEQYGQCVCSTWGEDHNQENFNSDNQG

SEQ ID NO: 198953 - protein, 37 aa, Artificial Sequence
  Description of Artificial Sequence: Synthetic polypeptide
DEECISTTNPVATEGYGQCVCSWGEHNQENFNSDTQS

SEQ ID NO: 198954 - protein, 37 aa, Artificial Sequence
  Description of Artificial Sequence: Synthetic polypeptide
DEECISTTNPVATEGYGQCVCSWGEENAENFGSDTQS

SEQ ID NO: 198955 - protein, 37 aa, Artificial Sequence
  Description of Artificial Sequence: Synthetic polypeptide
DEAEIRTTNPVATCHYGCVCSNWGEDNQEYFNSDTQS

SEQ ID NO: 198956 - protein, 39 aa, Artificial Sequence
  Description of Artificial Sequence: Synthetic polypeptide
DENEIRTTNPVATEQYGCAACMCVAGVLLQEVVVQEDRN

SEQ ID NO: 198957 - protein, 36 aa, Artificial Sequence
  Description of Artificial Sequence: Synthetic polypeptide
CETEIACTNPVATEQYGSACGAANPLPAEAPIGDHQ

SEQ ID NO: 198958 - protein, 37 aa, Artificial Sequence
  Description of Artificial Sequence: Synthetic polypeptide
DEEAISCTNPVATEQYGCVCSNWGEHNAENFNSETQA

SEQ ID NO: 198959 - protein, 38 aa, Artificial Sequence
  Description of Artificial Sequence: Synthetic polypeptide
DESTGCSTTNPVAYEQWGSVCSTPNGDHQQGDRKDEDN

SEQ ID NO: 198960 - protein, 39 aa, Artificial Sequence
  Description of Artificial Sequence: Synthetic polypeptide
DEMEIRTTNPVATEQYGCSISMMSEMSTEGAEWDDEGKK

SEQ ID NO: 198961 - protein, 36 aa, Artificial Sequence
  Description of Artificial Sequence: Synthetic polypeptide
TEQEIATTNPVAYEQPYGYNVAAANGDDDSNGEMRH

SEQ ID NO: 198962 - protein, 40 aa, Artificial Sequence
  Description of Artificial Sequence: Synthetic polypeptide
DEEEIRTTNPVATEQYGHSWYVNHASQPDDDASNEYQEEL

SEQ ID NO: 198963 - protein, 37 aa, Artificial Sequence
  Description of Artificial Sequence: Synthetic polypeptide
CEEEIACTNPVATEQYGSACSAANPHPAEAPIGDFHQ

SEQ ID NO: 198964 - protein, 39 aa, Artificial Sequence
  Description of Artificial Sequence: Synthetic polypeptide
DEEEIRTTNPVATEQYGHIVNNVPIEQTDNVHSAIESPE

SEQ ID NO: 198965 - protein, 33 aa, Artificial Sequence
  Description of Artificial Sequence: Synthetic polypeptide
AEAEIASTNPVGYEAYGVVMAYSPGLSGDVGDI

SEQ ID NO: 198966 - protein, 37 aa, Artificial Sequence
  Description of Artificial Sequence: Synthetic polypeptide
DEAEIRTTNPVATEQYGCWYNAFINHLSVLDSAEEQN

SEQ ID NO: 198967 - protein, 38 aa, Artificial Sequence
  Description of Artificial Sequence: Synthetic polypeptide
CDEEISTTNPVATEQYGCVCSNWGEDTNQENFGSDTQS

SEQ ID NO: 198968 - protein, 35 aa, Artificial Sequence
  Description of Artificial Sequence: Synthetic polypeptide
SAEEIATTNPVATAQWGCVAGPGNEPDNADPHGER

SEQ ID NO: 198969 - protein, 34 aa, Artificial Sequence
  Description of Artificial Sequence: Synthetic polypeptide
DEEEIASTNPIATECWGAVWANAEDWAEPKGPYQ

SEQ ID NO: 198970 - protein, 34 aa, Artificial Sequence
  Description of Artificial Sequence: Synthetic polypeptide
SAEEIATTNPVATAQWGCVAGPGNPDNADPHGHK

SEQ ID NO: 198971 - protein, 37 aa, Artificial Sequence
  Description of Artificial Sequence: Synthetic polypeptide
DEEEIRTTNPCATEEYGCVCGNWEDHNAENFNSDTAA

SEQ ID NO: 198972 - protein, 34 aa, Artificial Sequence
  Description of Artificial Sequence: Synthetic polypeptide
SAEEIATTNPVATAQWGCVAGPGNPDNADPHGIY

SEQ ID NO: 198973 - protein, 35 aa, Artificial Sequence
  Description of Artificial Sequence: Synthetic polypeptide
SAEEIATTNPVATAQWGCVAGPGNPDNADPHGSRT

SEQ ID NO: 198974 - protein, 36 aa, Artificial Sequence
  Description of Artificial Sequence: Synthetic polypeptide
DEEEIRTTNPCATEEYGCVCGMWGEHNAENFISDAA

SEQ ID NO: 198975 - protein, 38 aa, Artificial Sequence
  Description of Artificial Sequence: Synthetic polypeptide
VENEIRTTNPVATDQYGVVNMNLIMQGQLQEFEENNEQ

SEQ ID NO: 198976 - protein, 32 aa, Artificial Sequence
  Description of Artificial Sequence: Synthetic polypeptide
DESEIRSTNPIGTEGWGVTWANATWAEHGDYI

SEQ ID NO: 198977 - protein, 38 aa, Artificial Sequence
  Description of Artificial Sequence: Synthetic polypeptide
DEEEISTTNPVATEAYGQCVCSNWGEHNIENFNSDNQA

SEQ ID NO: 198978 - protein, 38 aa, Artificial Sequence
  Description of Artificial Sequence: Synthetic polypeptide
CEEAISTTNPVATEQYGCVCSTWGEDDNAENFNSDNQS

SEQ ID NO: 198979 - protein, 37 aa, Artificial Sequence
  Description of Artificial Sequence: Synthetic polypeptide
CEEAISTTNPVATEQYGCVCSWGEDHNAENFNSDTQA

SEQ ID NO: 198980 - protein, 33 aa, Artificial Sequence
  Description of Artificial Sequence: Synthetic polypeptide
DESEIRSTNPIATECWGATTWANADWAEPKGPI

SEQ ID NO: 198981 - protein, 33 aa, Artificial Sequence
  Description of Artificial Sequence: Synthetic polypeptide
DESEIRSTNPIATECWGATTWANADWAEPGPYI

SEQ ID NO: 198982 - protein, 38 aa, Artificial Sequence
  Description of Artificial Sequence: Synthetic polypeptide
QEEEIVTTNPVATEQYGVVMAGPIELGEGGQGEMNEDM

SEQ ID NO: 198983 - protein, 35 aa, Artificial Sequence
  Description of Artificial Sequence: Synthetic polypeptide
TEQPDEIATTNPVAYEPWGVVTGGNQQDRTGDGEE

SEQ ID NO: 198984 - protein, 34 aa, Artificial Sequence
  Description of Artificial Sequence: Synthetic polypeptide
DDSEVASTNPVSYEAYGNVVACNTISQSRTGGQR

SEQ ID NO: 198985 - protein, 35 aa, Artificial Sequence
  Description of Artificial Sequence: Synthetic polypeptide
DESQIRTTNPVAYEAWGISVCNAPSSSDREGGMVC

SEQ ID NO: 198986 - protein, 32 aa, Artificial Sequence
  Description of Artificial Sequence: Synthetic polypeptide
TESEIASTNPLGTEGYGVIAAPELSQSTGGDP

SEQ ID NO: 198987 - protein, 35 aa, Artificial Sequence
  Description of Artificial Sequence: Synthetic polypeptide
SEAEIATTNPVATEQWGCVAAKPGEEMGDEQENDM

SEQ ID NO: 198988 - protein, 32 aa, Artificial Sequence
  Description of Artificial Sequence: Synthetic polypeptide
TESEIASTNPVGTEAWGVCAPTDRDQHDGDQN

SEQ ID NO: 198989 - protein, 36 aa, Artificial Sequence
  Description of Artificial Sequence: Synthetic polypeptide
DEAEIRTTNPVATCHYGQCVCSWGEHNQYFTSDTQS

SEQ ID NO: 198990 - protein, 39 aa, Artificial Sequence
  Description of Artificial Sequence: Synthetic polypeptide
AEEEISTTNPVATEQYGQCVCSTWGEDHNQENFGSDTQS

SEQ ID NO: 198991 - protein, 38 aa, Artificial Sequence
  Description of Artificial Sequence: Synthetic polypeptide
DEEEISTTNPVATCQYGQCVCSWEEDHNQENFNSDNQA

SEQ ID NO: 198992 - protein, 35 aa, Artificial Sequence
  Description of Artificial Sequence: Synthetic polypeptide
DESQICTTNPVAYEAWGISVPNENSSSDREGGMVC

SEQ ID NO: 198993 - protein, 38 aa, Artificial Sequence
  Description of Artificial Sequence: Synthetic polypeptide
DEAEIRTTNPVATEQYGYISVYPIEPLKESFAEEESED

SEQ ID NO: 198994 - protein, 37 aa, Artificial Sequence
  Description of Artificial Sequence: Synthetic polypeptide
DEMTEIATTNPVAYEPWGSVCQTLDQSQQQGQGNNDA

SEQ ID NO: 198995 - protein, 36 aa, Artificial Sequence
  Description of Artificial Sequence: Synthetic polypeptide
NEDEIACTNPVAYEQWGCVTAANPGLQAAPDGANNH

SEQ ID NO: 198996 - protein, 38 aa, Artificial Sequence
  Description of Artificial Sequence: Synthetic polypeptide
CEEEIACTNPVATEQYGSACSAANPAEPADAEIGHNTW

SEQ ID NO: 198997 - protein, 33 aa, Artificial Sequence
  Description of Artificial Sequence: Synthetic polypeptide
TESEIASTNPVGTEGWGVCAPTDLQDHGQDTEQ

SEQ ID NO: 198998 - protein, 33 aa, Artificial Sequence
  Description of Artificial Sequence: Synthetic polypeptide
TESEIASTNPVGTEGWGVCAPTDLQDHQRQDTH

SEQ ID NO: 198999 - protein, 33 aa, Artificial Sequence
  Description of Artificial Sequence: Synthetic polypeptide
TESEIASTNPVGTEGWGVCAPTDLQDHTGDTES

SEQ ID NO: 199000 - protein, 38 aa, Artificial Sequence
  Description of Artificial Sequence: Synthetic polypeptide
EDETICTTNPVATESYGVVSTVVNDTGNGNDQTGTNVA

SEQ ID NO: 199001 - protein, 38 aa, Artificial Sequence
  Description of Artificial Sequence: Synthetic polypeptide
CEEEIVTTNPVATEQYGAVVDDNNVNFDEGFTNEGQTG

SEQ ID NO: 199002 - protein, 39 aa, Artificial Sequence
  Description of Artificial Sequence: Synthetic polypeptide
VENEIRTTNPVATEAYGEVSTTDGGNNLLHEEDEGAEGP

SEQ ID NO: 199003 - protein, 38 aa, Artificial Sequence
  Description of Artificial Sequence: Synthetic polypeptide
EDETICTTNPVATESYGVVSTVVVDQTGNNQETGTNVA

SEQ ID NO: 199004 - protein, 37 aa, Artificial Sequence
  Description of Artificial Sequence: Synthetic polypeptide
DEEEIGTTNPVATEQYGMVQFPIMGEEFPEPGSVAEI

SEQ ID NO: 199005 - protein, 37 aa, Artificial Sequence
  Description of Artificial Sequence: Synthetic polypeptide
CEEEIACTNPVATEQWGCVNACIGAHTNPADQTEGMD

SEQ ID NO: 199006 - protein, 38 aa, Artificial Sequence
  Description of Artificial Sequence: Synthetic polypeptide
DEEEISTTNPVATEAYGQCVCSNWEEHNAENFNSDTQA

SEQ ID NO: 199007 - protein, 38 aa, Artificial Sequence
  Description of Artificial Sequence: Synthetic polypeptide
DEEEISTTNPVATEAYGQCVCGNSGEHNQENFNSDNQS

SEQ ID NO: 199008 - protein, 37 aa, Artificial Sequence
  Description of Artificial Sequence: Synthetic polypeptide
QEEEIVTTNPVATEQYGVVMLGPIEPGEGGQGENEDQ

SEQ ID NO: 199009 - protein, 37 aa, Artificial Sequence
  Description of Artificial Sequence: Synthetic polypeptide
CEEEIACTNPVATEQWGCVAGTTGELTDPDMQMGDFP

SEQ ID NO: 199010 - protein, 34 aa, Artificial Sequence
  Description of Artificial Sequence: Synthetic polypeptide
VEDEIATTNPVAYEPYGETAAMANDQVSNDNTVN

SEQ ID NO: 199011 - protein, 35 aa, Artificial Sequence
  Description of Artificial Sequence: Synthetic polypeptide
VEDEIATTNPVAYEPWGTVSAANNEEMTAGGNNSL

SEQ ID NO: 199012 - protein, 39 aa, Artificial Sequence
  Description of Artificial Sequence: Synthetic polypeptide
DEEEIRTTNPVATEQYGIHRYNGNLRPETDTNTQIEMDF

SEQ ID NO: 199013 - protein, 37 aa, Artificial Sequence
  Description of Artificial Sequence: Synthetic polypeptide
DEAEIRCTNPVATEGWGCVCSNWGEENQEYFGSNTQS

SEQ ID NO: 199014 - protein, 35 aa, Artificial Sequence
  Description of Artificial Sequence: Synthetic polypeptide
DENENATTNPCAYECWGCVATDNGNQQLEGDHQRN

SEQ ID NO: 199015 - protein, 36 aa, Artificial Sequence
  Description of Artificial Sequence: Synthetic polypeptide
DESEIRPTNPVAYEAWGISVPVNANSSSDREDGMVC

SEQ ID NO: 199016 - protein, 37 aa, Artificial Sequence
  Description of Artificial Sequence: Synthetic polypeptide
QEEEIVTTNPVATEQYGVVMNGFIEGEGGQGEMNEDM

SEQ ID NO: 199017 - protein, 36 aa, Artificial Sequence
  Description of Artificial Sequence: Synthetic polypeptide
DESAEIATTNPCAYECWGSVATPNGNQQLEGDHQDK

SEQ ID NO: 199018 - protein, 35 aa, Artificial Sequence
  Description of Artificial Sequence: Synthetic polypeptide
DESSIATTNPVAYECWGSVYNWMNDVANREGHHME

SEQ ID NO: 199019 - protein, 37 aa, Artificial Sequence
  Description of Artificial Sequence: Synthetic polypeptide
QECEICTTNPVATEAYGVVSTVTQQGEQQGTTDEQEQ

SEQ ID NO: 199020 - protein, 37 aa, Artificial Sequence
  Description of Artificial Sequence: Synthetic polypeptide
DEEAISTTNPVATEGYGCVCSNWGEHNAENFNSDNQA

SEQ ID NO: 199021 - protein, 39 aa, Artificial Sequence
  Description of Artificial Sequence: Synthetic polypeptide
DECEICTTNPVATEQYGVVATVTQQGNTEQYGTTEQGSD

SEQ ID NO: 199022 - protein, 37 aa, Artificial Sequence
  Description of Artificial Sequence: Synthetic polypeptide
DEEAISTTNPVATEGYGCVCSNWGEHNAENFNSDNQS

SEQ ID NO: 199023 - protein, 35 aa, Artificial Sequence
  Description of Artificial Sequence: Synthetic polypeptide
SEAEIATTNPVATEGYGCVCSWEHNAEHFISETQA

SEQ ID NO: 199024 - protein, 39 aa, Artificial Sequence
  Description of Artificial Sequence: Synthetic polypeptide
FEEEIRTTNPVATEQYGQVSVMDDVNEMTGDEGGDEEFQ

SEQ ID NO: 199025 - protein, 35 aa, Artificial Sequence
  Description of Artificial Sequence: Synthetic polypeptide
CEEEIACTNPVATEQWGGCNAIIHLDPDDQMGQAM

SEQ ID NO: 199026 - protein, 38 aa, Artificial Sequence
  Description of Artificial Sequence: Synthetic polypeptide
DEEEIRTTNPVAYEEYGQCVCSNWEEHNAENFNSDNQS

SEQ ID NO: 199027 - protein, 39 aa, Artificial Sequence
  Description of Artificial Sequence: Synthetic polypeptide
DEECIRTTNPVATEQYGQCQVCSNWGEDNAEFFNSDNQS

SEQ ID NO: 199028 - protein, 38 aa, Artificial Sequence
  Description of Artificial Sequence: Synthetic polypeptide
AEEEISTTNPVATEQYGQCVCSNWEEDNTESFNSETQS

SEQ ID NO: 199029 - protein, 39 aa, Artificial Sequence
  Description of Artificial Sequence: Synthetic polypeptide
VENEIRTTNPVATEFYGEVSTTDGGNNLLHEEDEGFEGV

SEQ ID NO: 199030 - protein, 39 aa, Artificial Sequence
  Description of Artificial Sequence: Synthetic polypeptide
DEEAIRTTNPVATEQYGQCVCSNWGEDHNAENFNSDTQS

SEQ ID NO: 199031 - protein, 39 aa, Artificial Sequence
  Description of Artificial Sequence: Synthetic polypeptide
DEEAIRTTNPVATEQYGQCVCSNWGEDHNQENFGSDTQS

SEQ ID NO: 199032 - protein, 37 aa, Artificial Sequence
  Description of Artificial Sequence: Synthetic polypeptide
AEEEISTTNPVATEQYGQCVCSWEEHNQENFISEFQS

SEQ ID NO: 199033 - protein, 34 aa, Artificial Sequence
  Description of Artificial Sequence: Synthetic polypeptide
DEAEIATTNPVSTEPWGCIAPEDAQQQQQNGNTH

SEQ ID NO: 199034 - protein, 39 aa, Artificial Sequence
  Description of Artificial Sequence: Synthetic polypeptide
DEEAIRTTNPVATEQYGQCVCSNWGEDHNQENFNSDNQP

SEQ ID NO: 199035 - protein, 38 aa, Artificial Sequence
  Description of Artificial Sequence: Synthetic polypeptide
DEEEIRCTNPVATEQYGCVCSNWGEDDNAEGFISDTQA

SEQ ID NO: 199036 - protein, 37 aa, Artificial Sequence
  Description of Artificial Sequence: Synthetic polypeptide
DEACISTTNPVATEQYGCVCSNWGEHNAENFNSDTQA

SEQ ID NO: 199037 - protein, 38 aa, Artificial Sequence
  Description of Artificial Sequence: Synthetic polypeptide
AEEEISTTNPVATEQYGQCVCSNWEEHNAESFNSDTQA

SEQ ID NO: 199038 - protein, 37 aa, Artificial Sequence
  Description of Artificial Sequence: Synthetic polypeptide
DEECISTTNPVATEQWGCVCGNWNEDNAEGFNSDTQS

SEQ ID NO: 199039 - protein, 35 aa, Artificial Sequence
  Description of Artificial Sequence: Synthetic polypeptide
VEDEIATTNPVAYEQWGSVCADGPAGIPNDPMESW

SEQ ID NO: 199040 - protein, 39 aa, Artificial Sequence
  Description of Artificial Sequence: Synthetic polypeptide
DEEEIRTTNPVATEFYGVIVNMQGPVNMDNQTGEFTEEG

SEQ ID NO: 199041 - protein, 37 aa, Artificial Sequence
  Description of Artificial Sequence: Synthetic polypeptide
AEEEISTTNPVATEQYGQCVCSNWEHEQENFISQTQA

SEQ ID NO: 199042 - protein, 38 aa, Artificial Sequence
  Description of Artificial Sequence: Synthetic polypeptide
DEEAIRTTNPVATEQYGQCVCSNWGEHDAENFNSDTQA

SEQ ID NO: 199043 - protein, 38 aa, Artificial Sequence
  Description of Artificial Sequence: Synthetic polypeptide
DEDEIRTTNPVATEGYGMVNNDEFIDEQEDEFGGNQGN

SEQ ID NO: 199044 - protein, 39 aa, Artificial Sequence
  Description of Artificial Sequence: Synthetic polypeptide
DEEAIRTTNPVATEQYGQCVCSNWGEDHNAENFNSDTQP

SEQ ID NO: 199045 - protein, 37 aa, Artificial Sequence
  Description of Artificial Sequence: Synthetic polypeptide
DEDEIRTTNPVATEGYGMVNNDEFQQLIFTDDGGQGE

SEQ ID NO: 199046 - protein, 38 aa, Artificial Sequence
  Description of Artificial Sequence: Synthetic polypeptide
DEEEIACTNPVATEQYGCSSAANTHGPEANGNLTEAEN

SEQ ID NO: 199047 - protein, 37 aa, Artificial Sequence
  Description of Artificial Sequence: Synthetic polypeptide
QEEEISTTNPVTTEHWGSVYCWISNDQDDQLQGGDSI

SEQ ID NO: 199048 - protein, 39 aa, Artificial Sequence
  Description of Artificial Sequence: Synthetic polypeptide
TENEIRTTNPVATEQYGSTVICPVSLAQQVLTSGGAVSP

SEQ ID NO: 199049 - protein, 37 aa, Artificial Sequence
  Description of Artificial Sequence: Synthetic polypeptide
AEEEISTTNPVATEQYGQCVCSWGEHDIEHFNSDTQS

SEQ ID NO: 199050 - protein, 37 aa, Artificial Sequence
  Description of Artificial Sequence: Synthetic polypeptide
DEACISTTNPVATEQYGCSCSNWGEHNAENFGSDTQS

SEQ ID NO: 199051 - protein, 39 aa, Artificial Sequence
  Description of Artificial Sequence: Synthetic polypeptide
VENEIRTTNPVATEFYGEVSTTDGGNNLLHEEDEGLEQP

SEQ ID NO: 199052 - protein, 39 aa, Artificial Sequence
  Description of Artificial Sequence: Synthetic polypeptide
DEMESEIATTNPVAYEQWGSVAKTLEANGDGDGGGNTEK

SEQ ID NO: 199053 - protein, 37 aa, Artificial Sequence
  Description of Artificial Sequence: Synthetic polypeptide
TENEIRTTNPVSTEPYGCTVISCMEDAISQTMEPGNH

SEQ ID NO: 199054 - protein, 39 aa, Artificial Sequence
  Description of Artificial Sequence: Synthetic polypeptide
DEEAIRTTNPVATEQYGQCVCSNWGEDHNAENFISENQS

SEQ ID NO: 199055 - protein, 39 aa, Artificial Sequence
  Description of Artificial Sequence: Synthetic polypeptide
DEEAIRTTNPVATEQYGQCVCSNWGEDHNAENFNSDFQS

SEQ ID NO: 199056 - protein, 37 aa, Artificial Sequence
  Description of Artificial Sequence: Synthetic polypeptide
DEACISTTNPVATEQYGCVCENWGEPNAEYFGSQNQS

SEQ ID NO: 199057 - protein, 38 aa, Artificial Sequence
  Description of Artificial Sequence: Synthetic polypeptide
AEEEISTTNPVATEQYGQCVCSNSMEHNQENFGSETQA

SEQ ID NO: 199058 - protein, 37 aa, Artificial Sequence
  Description of Artificial Sequence: Synthetic polypeptide
NEAEICTTNPVATEQYGSVSFDWDSGGAFIFDGKQMQ

SEQ ID NO: 199059 - protein, 38 aa, Artificial Sequence
  Description of Artificial Sequence: Synthetic polypeptide
DEECIRTTNPVATEQYGQCVCGNWEEHNAENFNSDNQS

SEQ ID NO: 199060 - protein, 40 aa, Artificial Sequence
  Description of Artificial Sequence: Synthetic polypeptide
DEECIRTTNPVATEQYGQCQVTSTWGADDNAEYFNSDPQS

SEQ ID NO: 199061 - protein, 36 aa, Artificial Sequence
  Description of Artificial Sequence: Synthetic polypeptide
REGEIAPTNPCSYEQYGVTVSCCNMLSQSNGGTDRS

SEQ ID NO: 199062 - protein, 37 aa, Artificial Sequence
  Description of Artificial Sequence: Synthetic polypeptide
DEECISTTNPVATEQWGCVCQNWGEHNIEGFGSDNQS

SEQ ID NO: 199063 - protein, 38 aa, Artificial Sequence
  Description of Artificial Sequence: Synthetic polypeptide
DEMEISTTNPVATEQYGQCVCSNWGEHNEENFNSDTQS

SEQ ID NO: 199064 - protein, 37 aa, Artificial Sequence
  Description of Artificial Sequence: Synthetic polypeptide
CEEEIACTNPVATEQWGGCVAATNNDENGMPGEEDRL

SEQ ID NO: 199065 - protein, 38 aa, Artificial Sequence
  Description of Artificial Sequence: Synthetic polypeptide
DEMEISTTNPVATEQYGQCVCSNWGEHNQENFISENQA

SEQ ID NO: 199066 - protein, 38 aa, Artificial Sequence
  Description of Artificial Sequence: Synthetic polypeptide
DEMEISTTNPVATEQYGQCVCSNWGEHNQENFNSDTQS

SEQ ID NO: 199067 - protein, 35 aa, Artificial Sequence
  Description of Artificial Sequence: Synthetic polypeptide
VEDEIATTNPVAYEQWGSVAAGAGGQADSGDGSDD

SEQ ID NO: 199068 - protein, 37 aa, Artificial Sequence
  Description of Artificial Sequence: Synthetic polypeptide
CDEEISTTNPVATEQYGCVCSNWGEHNAENFISDNAS

SEQ ID NO: 199069 - protein, 38 aa, Artificial Sequence
  Description of Artificial Sequence: Synthetic polypeptide
NEAEIRTTNPVATEQYGCSCSNWGEDHNAEYFQSDTQA

SEQ ID NO: 199070 - protein, 38 aa, Artificial Sequence
  Description of Artificial Sequence: Synthetic polypeptide
CEEEISTTNPVATEQYGQCVCSNWGEPNQENFGSDTQQ

SEQ ID NO: 199071 - protein, 38 aa, Artificial Sequence
  Description of Artificial Sequence: Synthetic polypeptide
DSEEIGTTNPVATEAYGSTVCSDQAPEPSTIPGGNQVK

SEQ ID NO: 199072 - protein, 38 aa, Artificial Sequence
  Description of Artificial Sequence: Synthetic polypeptide
NEAEIRTTNPVATEQYGSTIPWTPPLEENQHSQIEIMQ

SEQ ID NO: 199073 - protein, 39 aa, Artificial Sequence
  Description of Artificial Sequence: Synthetic polypeptide
VENEIRTTNPVATEFYGCVNSTDGGNNLLHEEDEGQEGD

SEQ ID NO: 199074 - protein, 34 aa, Artificial Sequence
  Description of Artificial Sequence: Synthetic polypeptide
DEEEIASTNPIATECWGAVWSNDEDWAEPKGPYQ

SEQ ID NO: 199075 - protein, 36 aa, Artificial Sequence
  Description of Artificial Sequence: Synthetic polypeptide
VEDEIATTNPVAYEQWGSICANANNLQEAPTGTDDS

SEQ ID NO: 199076 - protein, 34 aa, Artificial Sequence
  Description of Artificial Sequence: Synthetic polypeptide
DEEEIASTNPIATECWGAVWSNAEDWAEPKGPYQ

SEQ ID NO: 199077 - protein, 36 aa, Artificial Sequence
  Description of Artificial Sequence: Synthetic polypeptide
TEQEIATTNPVATEQWGCVAGTGGHPTNPANENGEQ

SEQ ID NO: 199078 - protein, 36 aa, Artificial Sequence
  Description of Artificial Sequence: Synthetic polypeptide
TEQEIATTNPVATEQWGCVAGTGNHPTNPANEDGED

SEQ ID NO: 199079 - protein, 37 aa, Artificial Sequence
  Description of Artificial Sequence: Synthetic polypeptide
DEEEIATTNPVATEQWGHPVCMAGEGPHGENTSDIDH

SEQ ID NO: 199080 - protein, 35 aa, Artificial Sequence
  Description of Artificial Sequence: Synthetic polypeptide
CEEEIACTNPVATEQWGGCNAIIHLVQPDDQGQAM

SEQ ID NO: 199081 - protein, 37 aa, Artificial Sequence
  Description of Artificial Sequence: Synthetic polypeptide
DEEEIRTTNPCATEEYGCVCGNWGEDHAENFGSDTAA

SEQ ID NO: 199082 - protein, 38 aa, Artificial Sequence
  Description of Artificial Sequence: Synthetic polypeptide
QEEEIATTNPVATEQWGCNVAGNNGGLPEENNHGIDNG

SEQ ID NO: 199083 - protein, 37 aa, Artificial Sequence
  Description of Artificial Sequence: Synthetic polypeptide
DEAEIRTTNPVATEQYGCWYNAVCNHMSVLDSAEEQN

SEQ ID NO: 199084 - protein, 38 aa, Artificial Sequence
  Description of Artificial Sequence: Synthetic polypeptide
DEEEISTTNPVATEEYGCVCSNSGEDHNAENFNSDTQS

SEQ ID NO: 199085 - protein, 37 aa, Artificial Sequence
  Description of Artificial Sequence: Synthetic polypeptide
NQEEIGTTNPVATEQYGSVPVVPSGLDEVIVLEPTGY

SEQ ID NO: 199086 - protein, 37 aa, Artificial Sequence
  Description of Artificial Sequence: Synthetic polypeptide
DESTVIQTTNPVAYEQWGCVAACTNNAPSQRPPGQYP

SEQ ID NO: 199087 - protein, 38 aa, Artificial Sequence
  Description of Artificial Sequence: Synthetic polypeptide
DEMEIRTTNPVATEQYGCVCQNWGEDHNIENFMSDTQS

SEQ ID NO: 199088 - protein, 38 aa, Artificial Sequence
  Description of Artificial Sequence: Synthetic polypeptide
DEMEISTTNPVATEQYGQCVCSNWGEPNEEYFGSDTQS

SEQ ID NO: 199089 - protein, 39 aa, Artificial Sequence
  Description of Artificial Sequence: Synthetic polypeptide
DEMEISTTNPVATEQYGQCVCSTWGEDHNAENFNSDNQP

SEQ ID NO: 199090 - protein, 38 aa, Artificial Sequence
  Description of Artificial Sequence: Synthetic polypeptide
CEEEISTTNPVATEQYGQCVCSNWGEPNAENFNSDPQS

SEQ ID NO: 199091 - protein, 39 aa, Artificial Sequence
  Description of Artificial Sequence: Synthetic polypeptide
DEAEIRTTNPVATAQYGQSGVGYCSENFQLDFESLEDPN

SEQ ID NO: 199092 - protein, 33 aa, Artificial Sequence
  Description of Artificial Sequence: Synthetic polypeptide
AEAEIASTNPVGYEAYGVVMAYSPGQSQVVGDI

SEQ ID NO: 199093 - protein, 38 aa, Artificial Sequence
  Description of Artificial Sequence: Synthetic polypeptide
DESEIRSTNPVATEQYGDYGMDQSNIAGQSNEGDGNGE

SEQ ID NO: 199094 - protein, 37 aa, Artificial Sequence
  Description of Artificial Sequence: Synthetic polypeptide
DESEIRSTNPVATEQYGAVMESADGSGEFTDTEGQGT

SEQ ID NO: 199095 - protein, 39 aa, Artificial Sequence
  Description of Artificial Sequence: Synthetic polypeptide
VENEIRTTNPVATEFYGCVNTQDTGGNNLLHEEDEGNEG

SEQ ID NO: 199096 - protein, 38 aa, Artificial Sequence
  Description of Artificial Sequence: Synthetic polypeptide
DEMNEIATTNPVAYEQWGEVCSTPNQGNHGEEGGDRGN

SEQ ID NO: 199097 - protein, 37 aa, Artificial Sequence
  Description of Artificial Sequence: Synthetic polypeptide
NEAEIRTTNPVATEHYGVVPCEINDGQQQQGHGGDDK

SEQ ID NO: 199098 - protein, 35 aa, Artificial Sequence
  Description of Artificial Sequence: Synthetic polypeptide
VEDEIATTNPVAYEQWGSVCAAAGGLDNDDNDNQN

SEQ ID NO: 199099 - protein, 38 aa, Artificial Sequence
  Description of Artificial Sequence: Synthetic polypeptide
DDNEISTTNPVATEQYGQCVCSNSGEHNAENFGSDNQA

SEQ ID NO: 199100 - protein, 32 aa, Artificial Sequence
  Description of Artificial Sequence: Synthetic polypeptide
EEAEIATTNPVAYECWGTVYYVEDIHQHNEKD

SEQ ID NO: 199101 - protein, 37 aa, Artificial Sequence
  Description of Artificial Sequence: Synthetic polypeptide
DDNEISTTNPVATEQYGCVCSNWGEEHNAENFNSEQS

SEQ ID NO: 199102 - protein, 37 aa, Artificial Sequence
  Description of Artificial Sequence: Synthetic polypeptide
CDEEISTTNPVATEQYGCVCSNWGEHNIEHFNSDTQA

SEQ ID NO: 199103 - protein, 39 aa, Artificial Sequence
  Description of Artificial Sequence: Synthetic polypeptide
DEMEISTTNPVATEQYGQCVTSTWGADHNAEHFGSDPQS

SEQ ID NO: 199104 - protein, 37 aa, Artificial Sequence
  Description of Artificial Sequence: Synthetic polypeptide
CDEEISTTNPVATEQYGCVCSNWGEHNAENFLSDNQS

SEQ ID NO: 199105 - protein, 35 aa, Artificial Sequence
  Description of Artificial Sequence: Synthetic polypeptide
VEDEIATTNPVAYEQWGSVAATAHGAAAPPGSTHN

SEQ ID NO: 199106 - protein, 38 aa, Artificial Sequence
  Description of Artificial Sequence: Synthetic polypeptide
EDETICTTNPVATESYGVVSTVVNDQTGNNNQTGTNTV

SEQ ID NO: 199107 - protein, 39 aa, Artificial Sequence
  Description of Artificial Sequence: Synthetic polypeptide
AEEEISTTNPVATEQYGQCVCSTWGEDHNAENFNSDTQS

SEQ ID NO: 199108 - protein, 35 aa, Artificial Sequence
  Description of Artificial Sequence: Synthetic polypeptide
DEMAIGTTNPVATEQYGCLCTAKEGSPVEFETNKQ

SEQ ID NO: 199109 - protein, 39 aa, Artificial Sequence
  Description of Artificial Sequence: Synthetic polypeptide
DEEEIRTTNPVATEQYGMSYCQPWPPNMGMEIKLVGQMP

SEQ ID NO: 199110 - protein, 37 aa, Artificial Sequence
  Description of Artificial Sequence: Synthetic polypeptide
DEEEIATTNPVATEQYGSCAAAMGHGPADSGEGDGGH

SEQ ID NO: 199111 - protein, 38 aa, Artificial Sequence
  Description of Artificial Sequence: Synthetic polypeptide
DEEEIACTNPVATEQYGSACAAINPAEEAGAHMDNGAP

SEQ ID NO: 199112 - protein, 35 aa, Artificial Sequence
  Description of Artificial Sequence: Synthetic polypeptide
VEEVIACTNPVATEQWGGCVAGTGELITNMQMEAV

SEQ ID NO: 199113 - protein, 34 aa, Artificial Sequence
  Description of Artificial Sequence: Synthetic polypeptide
VEEVIACTNPVATEQWGGCTVAGTGELITNMMAE

SEQ ID NO: 199114 - protein, 37 aa, Artificial Sequence
  Description of Artificial Sequence: Synthetic polypeptide
CEEEISTTNPVAYEQYGCVCSNWGEHNQENFNSDNQM

SEQ ID NO: 199115 - protein, 37 aa, Artificial Sequence
  Description of Artificial Sequence: Synthetic polypeptide
DEEEIATTNPVATEQYGSCAAAMGHGPADSGEGDTHI

SEQ ID NO: 199116 - protein, 38 aa, Artificial Sequence
  Description of Artificial Sequence: Synthetic polypeptide
NEECIRTTNPVATEQYGQCVCSNWGEHNTEFFNSDTQS

SEQ ID NO: 199117 - protein, 38 aa, Artificial Sequence
  Description of Artificial Sequence: Synthetic polypeptide
DEAEISTTNPVATEQYGQCVCSDWGEHNQENFNSDTQS

SEQ ID NO: 199118 - protein, 35 aa, Artificial Sequence
  Description of Artificial Sequence: Synthetic polypeptide
AENEIACTNPVATEQYGCSCSWMEHNQNFISQTQS

SEQ ID NO: 199119 - protein, 36 aa, Artificial Sequence
  Description of Artificial Sequence: Synthetic polypeptide
AEEEIATTNPVATAQWGGCCAGTNGLEATANGDEFT

SEQ ID NO: 199120 - protein, 36 aa, Artificial Sequence
  Description of Artificial Sequence: Synthetic polypeptide
AEEEIATTNPTAYEPWGNVCSTIEQDQRDQQQIGHG

SEQ ID NO: 199121 - protein, 36 aa, Artificial Sequence
  Description of Artificial Sequence: Synthetic polypeptide
AENEIACTNPVATEQYGCSCSWGELNIENFGSQTQS

SEQ ID NO: 199122 - protein, 33 aa, Artificial Sequence
  Description of Artificial Sequence: Synthetic polypeptide
AEAEIASTNPVGYEAYGVVMAYEPGLSQHVGDF

SEQ ID NO: 199123 - protein, 39 aa, Artificial Sequence
  Description of Artificial Sequence: Synthetic polypeptide
DEEEIGTTNPVATEQYGQCVCSNWGEDHNAENFNSDNQS

SEQ ID NO: 199124 - protein, 38 aa, Artificial Sequence
  Description of Artificial Sequence: Synthetic polypeptide
QEPEICTTNPVATEQYGSVVILDFEGLEQDENENFEGT

SEQ ID NO: 199125 - protein, 36 aa, Artificial Sequence
  Description of Artificial Sequence: Synthetic polypeptide
AEEEIATTNPVATASWGCVSATGAGGTAPQDIANFK

SEQ ID NO: 199126 - protein, 38 aa, Artificial Sequence
  Description of Artificial Sequence: Synthetic polypeptide
DEEEIRTTNPVATEQWGHVVANAGPAQGTEHQDDIVAD

SEQ ID NO: 199127 - protein, 38 aa, Artificial Sequence
  Description of Artificial Sequence: Synthetic polypeptide
DEEEIRTTNPVATEQWGIAWSLYNIGNDEWGGTYQEGQ

SEQ ID NO: 199128 - protein, 38 aa, Artificial Sequence
  Description of Artificial Sequence: Synthetic polypeptide
DENEIRTTNPVATEQYGACCWVADVDVEPLEGGEDHLH

SEQ ID NO: 199129 - protein, 35 aa, Artificial Sequence
  Description of Artificial Sequence: Synthetic polypeptide
DEDEIATTNPVATEQWGCVAAKPGEEMADEQNNDD

SEQ ID NO: 199130 - protein, 38 aa, Artificial Sequence
  Description of Artificial Sequence: Synthetic polypeptide
DEEAISTTNPVATEQYGCVCSNWGEDHNQENFISDNQP

SEQ ID NO: 199131 - protein, 37 aa, Artificial Sequence
  Description of Artificial Sequence: Synthetic polypeptide
DENEIATTNPVATEQYGSACAGMTHGGAEAPINDNHD

SEQ ID NO: 199132 - protein, 38 aa, Artificial Sequence
  Description of Artificial Sequence: Synthetic polypeptide
DEEAISTTNPVATEQYGCVCSNWGEDHNQEYFNSDNQA

SEQ ID NO: 199133 - protein, 37 aa, Artificial Sequence
  Description of Artificial Sequence: Synthetic polypeptide
EDETICTTNPVATEQWGTVSTVVNNLNGSEEGTVVTD

SEQ ID NO: 199134 - protein, 37 aa, Artificial Sequence
  Description of Artificial Sequence: Synthetic polypeptide
CEEEISTTNPVAYEQYGQCVCSNWEHNQENFGSDTQS

SEQ ID NO: 199135 - protein, 37 aa, Artificial Sequence
  Description of Artificial Sequence: Synthetic polypeptide
DEEEISTTNPEATEQYGCVCPNWGEDHNAEYFGSDQA

SEQ ID NO: 199136 - protein, 38 aa, Artificial Sequence
  Description of Artificial Sequence: Synthetic polypeptide
DEEAISTTNPVATEQYGCVCSNWGEDHNQEYFNSDTQS

SEQ ID NO: 199137 - protein, 35 aa, Artificial Sequence
  Description of Artificial Sequence: Synthetic polypeptide
DEEEIATTNPVAYAQWGTSACAAANGDANQTDQHQ

SEQ ID NO: 199138 - protein, 38 aa, Artificial Sequence
  Description of Artificial Sequence: Synthetic polypeptide
DEEEIACTNPVATEQYGSACAAANPDEEAGAHQDEDNN

SEQ ID NO: 199139 - protein, 37 aa, Artificial Sequence
  Description of Artificial Sequence: Synthetic polypeptide
CDEEISTTNPVATEQYGCVCSNSGEHNAENFNSDTQA

SEQ ID NO: 199140 - protein, 38 aa, Artificial Sequence
  Description of Artificial Sequence: Synthetic polypeptide
DESEVICTTNPIAYEPYGSVVCGQDNELSQAEGTSNGI

SEQ ID NO: 199141 - protein, 36 aa, Artificial Sequence
  Description of Artificial Sequence: Synthetic polypeptide
DDEEISTTNPVATEQWGCVTSNWGEHNANFNSDTAS

SEQ ID NO: 199142 - protein, 37 aa, Artificial Sequence
  Description of Artificial Sequence: Synthetic polypeptide
DEMVIGTTNPVATEQWGQCVCSWGEDHNQYFGSDNQA

SEQ ID NO: 199143 - protein, 37 aa, Artificial Sequence
  Description of Artificial Sequence: Synthetic polypeptide
DENQICTTNPVATEQYGSAFTDWTYDPGTQFQSNQIM

SEQ ID NO: 199144 - protein, 38 aa, Artificial Sequence
  Description of Artificial Sequence: Synthetic polypeptide
DEEEIACTNPVATEQYGSACAAINPAEEAGAEQDNNAP

SEQ ID NO: 199145 - protein, 36 aa, Artificial Sequence
  Description of Artificial Sequence: Synthetic polypeptide
DEDEIATTNPVATEQWGCVAAKPGFEEMGDEQNNDM

SEQ ID NO: 199146 - protein, 38 aa, Artificial Sequence
  Description of Artificial Sequence: Synthetic polypeptide
DEAEISTTNPVATEQYGQCVCSMWGEDNQENFNSDTQS

SEQ ID NO: 199147 - protein, 36 aa, Artificial Sequence
  Description of Artificial Sequence: Synthetic polypeptide
AENEIACTNPVATEQYGCSCSWGEDNQENFGSDTQS

SEQ ID NO: 199148 - protein, 36 aa, Artificial Sequence
  Description of Artificial Sequence: Synthetic polypeptide
AENEIACTNPVATEQYGCSCSWGEDNAENFGSQTQA

SEQ ID NO: 199149 - protein, 38 aa, Artificial Sequence
  Description of Artificial Sequence: Synthetic polypeptide
DEAEISTTNPVATEQYGQCVCSMWGEHNQENFGSQTQS

SEQ ID NO: 199150 - protein, 39 aa, Artificial Sequence
  Description of Artificial Sequence: Synthetic polypeptide
DEPEIRTTNPVATEGYGVVDVGVGTGNDGQQEGEGQDTS

SEQ ID NO: 199151 - protein, 35 aa, Artificial Sequence
  Description of Artificial Sequence: Synthetic polypeptide
DESENATTNPCAYECWGCVATGNGNQQLEGDHQRR

SEQ ID NO: 199152 - protein, 37 aa, Artificial Sequence
  Description of Artificial Sequence: Synthetic polypeptide
CDEEISTTNPVATEQYGCVCGNWGEHNQENFGSDFQS

SEQ ID NO: 199153 - protein, 35 aa, Artificial Sequence
  Description of Artificial Sequence: Synthetic polypeptide
NEEEIACTNPVATEQWGGCCTAAAGNPDNMAPNHN

SEQ ID NO: 199154 - protein, 38 aa, Artificial Sequence
  Description of Artificial Sequence: Synthetic polypeptide
DEEEIRTTNPVCTEAYGCVCSNWGEDHNQENFGSDTQA

SEQ ID NO: 199155 - protein, 35 aa, Artificial Sequence
  Description of Artificial Sequence: Synthetic polypeptide
DEAEICTTNPMATETYGSVPIPDPMQHVSSEAFWG

SEQ ID NO: 199156 - protein, 39 aa, Artificial Sequence
  Description of Artificial Sequence: Synthetic polypeptide
DEEEIGTTNPVATEQYGQCVCSNWGEDHNIEGFNSDTQA

SEQ ID NO: 199157 - protein, 35 aa, Artificial Sequence
  Description of Artificial Sequence: Synthetic polypeptide
SEEEIATTNPVAYEQYGEHAWCEHEHSQNAEGELN

SEQ ID NO: 199158 - protein, 38 aa, Artificial Sequence
  Description of Artificial Sequence: Synthetic polypeptide
DEAEISTVNPVATEQYGQCVCSNSGEDNAENFGSDNQA

SEQ ID NO: 199159 - protein, 37 aa, Artificial Sequence
  Description of Artificial Sequence: Synthetic polypeptide
DEEEIACTNPVATEQYGSACAANPAEGQDHQDDSETW

SEQ ID NO: 199160 - protein, 39 aa, Artificial Sequence
  Description of Artificial Sequence: Synthetic polypeptide
DEEEIGTTNPVATEQYGQCVCSNWGEDHNIENFNSDTQA

SEQ ID NO: 199161 - protein, 38 aa, Artificial Sequence
  Description of Artificial Sequence: Synthetic polypeptide
DENEIRTTNPVATEIFGCASTWNSVPNEHERDNNQYYF

SEQ ID NO: 199162 - protein, 37 aa, Artificial Sequence
  Description of Artificial Sequence: Synthetic polypeptide
EDETICTTNPVATEQWGTVSTTNNNEQGSEQGTTVDD

SEQ ID NO: 199163 - protein, 33 aa, Artificial Sequence
  Description of Artificial Sequence: Synthetic polypeptide
QENEIATTNPVAYAPWGNTVAGEGHLQHPMNMH

SEQ ID NO: 199164 - protein, 34 aa, Artificial Sequence
  Description of Artificial Sequence: Synthetic polypeptide
QENEIATTNPVATECYGATTANEECWAEHKGEYI

SEQ ID NO: 199165 - protein, 34 aa, Artificial Sequence
  Description of Artificial Sequence: Synthetic polypeptide
QENEIATTNPVATECYGATTANEECWAEHKGEYL

SEQ ID NO: 199166 - protein, 37 aa, Artificial Sequence
  Description of Artificial Sequence: Synthetic polypeptide
DEEVIATTNPVAIYETYGSVPTDKSMFTVISGNEEFE

SEQ ID NO: 199167 - protein, 37 aa, Artificial Sequence
  Description of Artificial Sequence: Synthetic polypeptide
NEEEIACTNPVATEQWGCVAGTPGGLTDPDSQMGSAM

SEQ ID NO: 199168 - protein, 36 aa, Artificial Sequence
  Description of Artificial Sequence: Synthetic polypeptide
CEDEIATTNPVAYEQYGSCATGPAEGPNHQMDMQMN

SEQ ID NO: 199169 - protein, 38 aa, Artificial Sequence
  Description of Artificial Sequence: Synthetic polypeptide
DEMEIRTTNPVATEQWGCVCSNSGEDDNAEASNSDTAS

SEQ ID NO: 199170 - protein, 37 aa, Artificial Sequence
  Description of Artificial Sequence: Synthetic polypeptide
CEEEIATTNPVATEQWGSVSVADGAGATAHGDDLAVM

SEQ ID NO: 199171 - protein, 35 aa, Artificial Sequence
  Description of Artificial Sequence: Synthetic polypeptide
DEDEIATTNPVATEQWGCVAGEGGVGGHQDDMLAE

SEQ ID NO: 199172 - protein, 38 aa, Artificial Sequence
  Description of Artificial Sequence: Synthetic polypeptide
DEEEIATTNPVATEQYGSCAAGMGNGDTATGMLMDDPH

SEQ ID NO: 199173 - protein, 38 aa, Artificial Sequence
  Description of Artificial Sequence: Synthetic polypeptide
DEAEISTTNPVATEQYGQCVCSNSGEDNAENFNSDNQS

SEQ ID NO: 199174 - protein, 38 aa, Artificial Sequence
  Description of Artificial Sequence: Synthetic polypeptide
DEQEIRATNPVATEQYGVVMSDNDNNTEGPGQTDQTGD

SEQ ID NO: 199175 - protein, 37 aa, Artificial Sequence
  Description of Artificial Sequence: Synthetic polypeptide
DEEEIATTNPVATEQYGSCAAMGHGGPADSGEGTDHV

SEQ ID NO: 199176 - protein, 37 aa, Artificial Sequence
  Description of Artificial Sequence: Synthetic polypeptide
NEEEIAATNPVAYESWGHVCSKNDQQQERERGNTESK

SEQ ID NO: 199177 - protein, 38 aa, Artificial Sequence
  Description of Artificial Sequence: Synthetic polypeptide
DEAEISTTNPVATEQYGQCVCSNSGEHNAENFNSDTQS

SEQ ID NO: 199178 - protein, 38 aa, Artificial Sequence
  Description of Artificial Sequence: Synthetic polypeptide
DEEEIACTNPVATEQYGSACAAINPPEEAGAHIDNDAP

SEQ ID NO: 199179 - protein, 38 aa, Artificial Sequence
  Description of Artificial Sequence: Synthetic polypeptide
CEEEIATTNPVATEQYGCTACAVNPAEGQNHQDGMQMN

SEQ ID NO: 199180 - protein, 36 aa, Artificial Sequence
  Description of Artificial Sequence: Synthetic polypeptide
DEDEIATTNPVATEQWGCVAGENGVEMNAAEMDNNM

SEQ ID NO: 199181 - protein, 37 aa, Artificial Sequence
  Description of Artificial Sequence: Synthetic polypeptide
AENEIACTNPVATEQYGCSCSWGEDHNQEYFGSQNQA

SEQ ID NO: 199182 - protein, 38 aa, Artificial Sequence
  Description of Artificial Sequence: Synthetic polypeptide
DEEEIACTNPVATEQYGSACAANNPDEEAGAHGDEHNH

SEQ ID NO: 199183 - protein, 38 aa, Artificial Sequence
  Description of Artificial Sequence: Synthetic polypeptide
DEPEIPIVTNTVATEQYGDVGEPWVTMPEMRTVGVNVR

SEQ ID NO: 199184 - protein, 32 aa, Artificial Sequence
  Description of Artificial Sequence: Synthetic polypeptide
DESEVASTNPISTEGWGNTANNTWQSPVGQYR

SEQ ID NO: 199185 - protein, 33 aa, Artificial Sequence
  Description of Artificial Sequence: Synthetic polypeptide
DESEVASTNPIATEGWGNTWANNTWQEPVGQYR

SEQ ID NO: 199186 - protein, 38 aa, Artificial Sequence
  Description of Artificial Sequence: Synthetic polypeptide
CEECIRTTNPVATEQYGCVCSNWGEDHNAENFNSDNQS

SEQ ID NO: 199187 - protein, 37 aa, Artificial Sequence
  Description of Artificial Sequence: Synthetic polypeptide
DEMEIRTTNPVATEQWGCVCSNSGEENAEYFISDTAS

SEQ ID NO: 199188 - protein, 37 aa, Artificial Sequence
  Description of Artificial Sequence: Synthetic polypeptide
YEEEIRTTNPVATEFYGMVSAEGMGDGGQGQEAQEGT

SEQ ID NO: 199189 - protein, 37 aa, Artificial Sequence
  Description of Artificial Sequence: Synthetic polypeptide
CDEEISTTNPVATEQYGCVCSNWEDHNAENFNSDNQS

SEQ ID NO: 199190 - protein, 38 aa, Artificial Sequence
  Description of Artificial Sequence: Synthetic polypeptide
DEEAISTTNPVATEQYGCVCSNWGEDHNAEYFMSDNQS

SEQ ID NO: 199191 - protein, 38 aa, Artificial Sequence
  Description of Artificial Sequence: Synthetic polypeptide
DEEAISTTNPVATEQYGCVCSNWGEDHNAENFNSDTQS

SEQ ID NO: 199192 - protein, 38 aa, Artificial Sequence
  Description of Artificial Sequence: Synthetic polypeptide
DEEEISTTNPVATCQYGQCVCSNWGEHNIENFNSDNQA

SEQ ID NO: 199193 - protein, 38 aa, Artificial Sequence
  Description of Artificial Sequence: Synthetic polypeptide
DEAEISTTNPVATEQYGQCVCGNSGEHNAENFGSDTQA

SEQ ID NO: 199194 - protein, 37 aa, Artificial Sequence
  Description of Artificial Sequence: Synthetic polypeptide
DEIAEIATTNPVAYEQWGSVACGTPDDDHRSNHKDIT

SEQ ID NO: 199195 - protein, 37 aa, Artificial Sequence
  Description of Artificial Sequence: Synthetic polypeptide
DDEEISTTNPVATEGYGQCVCSWGEHNQENFNSETQA

SEQ ID NO: 199196 - protein, 39 aa, Artificial Sequence
  Description of Artificial Sequence: Synthetic polypeptide
NEDEIRTTNPVATEFYGQVVINDEFGDQDQIGNGGGNAR

SEQ ID NO: 199197 - protein, 38 aa, Artificial Sequence
  Description of Artificial Sequence: Synthetic polypeptide
DESNEIATTNPVAYEQWGEVCSTPNQGNHGEAGGDGND

SEQ ID NO: 199198 - protein, 39 aa, Artificial Sequence
  Description of Artificial Sequence: Synthetic polypeptide
NEDEIRTTNPVATEFYGQVVISDEFGTQDQIGNIGGNAT

SEQ ID NO: 199199 - protein, 38 aa, Artificial Sequence
  Description of Artificial Sequence: Synthetic polypeptide
DESEIRGTNPVATEQYGAIIVVGEGNNNMNDGGNDQQL

SEQ ID NO: 199200 - protein, 39 aa, Artificial Sequence
  Description of Artificial Sequence: Synthetic polypeptide
NEDEIRTTNPVATEFYGQVVISDEFGTQDQQGVEGGNAI

SEQ ID NO: 199201 - protein, 32 aa, Artificial Sequence
  Description of Artificial Sequence: Synthetic polypeptide
DDSEVGSTNPVSTEGYGAVAANTIGVSGVGQK

SEQ ID NO: 199202 - protein, 38 aa, Artificial Sequence
  Description of Artificial Sequence: Synthetic polypeptide
DESEIRGTNPVATEQYGAIIVVGEGNNMVDGGNDQDQL

SEQ ID NO: 199203 - protein, 35 aa, Artificial Sequence
  Description of Artificial Sequence: Synthetic polypeptide
DEMEIRTTNPVATEQYGCAICPQDMIEDSESSQME

SEQ ID NO: 199204 - protein, 38 aa, Artificial Sequence
  Description of Artificial Sequence: Synthetic polypeptide
DEEEISTTNPVATCQYGQCVCSNWGEHNAENFNSDNQS

SEQ ID NO: 199205 - protein, 39 aa, Artificial Sequence
  Description of Artificial Sequence: Synthetic polypeptide
NEDEIRTTNPVATEFYGQVVISDEFGTQDQSGNIGGNDI

SEQ ID NO: 199206 - protein, 38 aa, Artificial Sequence
  Description of Artificial Sequence: Synthetic polypeptide
DESEIRGTNPVATEQYGAIIVGGEGNNNMNDGGNDQND

SEQ ID NO: 199207 - protein, 38 aa, Artificial Sequence
  Description of Artificial Sequence: Synthetic polypeptide
DESEIRGTNPVATEQYGAIIVGEGNNFDNDGGNDQVQL

SEQ ID NO: 199208 - protein, 38 aa, Artificial Sequence
  Description of Artificial Sequence: Synthetic polypeptide
DESEIRGTNPVATEQYGAIITGEGNNMDNDGGNDQLQQ

SEQ ID NO: 199209 - protein, 35 aa, Artificial Sequence
  Description of Artificial Sequence: Synthetic polypeptide
NEDEIATTNPVAYERWGSVYSGGNPGNAGEHDGTD

SEQ ID NO: 199210 - protein, 38 aa, Artificial Sequence
  Description of Artificial Sequence: Synthetic polypeptide
CEEEIACTNPVATEQYGSACGPTPDGHPLEAAEGFNNQ

SEQ ID NO: 199211 - protein, 38 aa, Artificial Sequence
  Description of Artificial Sequence: Synthetic polypeptide
DEAEIRTTNPVATEWYGQAWYTYNPDPGMDLEINHYQE

SEQ ID NO: 199212 - protein, 38 aa, Artificial Sequence
  Description of Artificial Sequence: Synthetic polypeptide
DEEEISTTNPVATCQYGQCVCSNWGEHNIENFNSDTQS

SEQ ID NO: 199213 - protein, 33 aa, Artificial Sequence
  Description of Artificial Sequence: Synthetic polypeptide
AEAEIASTNPVGYEAYGVVMAYSPGFSQHVGDW

SEQ ID NO: 199214 - protein, 38 aa, Artificial Sequence
  Description of Artificial Sequence: Synthetic polypeptide
CEEEIACTNPVATEQYGSACSAANPAEIADAEIGANTQ

SEQ ID NO: 199215 - protein, 37 aa, Artificial Sequence
  Description of Artificial Sequence: Synthetic polypeptide
DEAEIRTTNPVATEQYGYISYPIFPLDESFAEEEIED

SEQ ID NO: 199216 - protein, 37 aa, Artificial Sequence
  Description of Artificial Sequence: Synthetic polypeptide
CEMEISTTNPVATEQYGCVCSNWGEHNAENFNSDTQS

SEQ ID NO: 199217 - protein, 36 aa, Artificial Sequence
  Description of Artificial Sequence: Synthetic polypeptide
QEEEIATTNPVATEQWGCVAGAQGPAEGANHGTPMF

SEQ ID NO: 199218 - protein, 38 aa, Artificial Sequence
  Description of Artificial Sequence: Synthetic polypeptide
EDETICTTNPVATESYGVVSTVVADQTGNNNQTGTNVA

SEQ ID NO: 199219 - protein, 32 aa, Artificial Sequence
  Description of Artificial Sequence: Synthetic polypeptide
TESEIASTNPVGTEGWGVCAPTDQQDHQGDTE

SEQ ID NO: 199220 - protein, 38 aa, Artificial Sequence
  Description of Artificial Sequence: Synthetic polypeptide
DDEEIRCTNPVATEQYGQCVCSNWGEHNQENFNSDTQA

SEQ ID NO: 199221 - protein, 32 aa, Artificial Sequence
  Description of Artificial Sequence: Synthetic polypeptide
TESEIASTNPVGTEGWGVCAPTDRDQHGGGDA

SEQ ID NO: 199222 - protein, 38 aa, Artificial Sequence
  Description of Artificial Sequence: Synthetic polypeptide
DESEIRGTNPVATEQYGVVGDLVNNSEGMEEGNEDGDA

SEQ ID NO: 199223 - protein, 37 aa, Artificial Sequence
  Description of Artificial Sequence: Synthetic polypeptide
CEEEISTTNPVAYEQYGQCVCSWEEPNTEGFNSDTQS

SEQ ID NO: 199224 - protein, 32 aa, Artificial Sequence
  Description of Artificial Sequence: Synthetic polypeptide
TESEIASTNPVGTEGWGVCAPTDRDQHGQKQG

SEQ ID NO: 199225 - protein, 35 aa, Artificial Sequence
  Description of Artificial Sequence: Synthetic polypeptide
NEGEVISTTNPVAYEHWGITVCTLEEGSNSSNNRM

SEQ ID NO: 199226 - protein, 32 aa, Artificial Sequence
  Description of Artificial Sequence: Synthetic polypeptide
TESEIASTNPVGTEGWGVCAPTDRDQHNGDAS

SEQ ID NO: 199227 - protein, 38 aa, Artificial Sequence
  Description of Artificial Sequence: Synthetic polypeptide
DEEEIRTTNPVCTEHYGQCVCSNWGEHNQENFNSDTQA

SEQ ID NO: 199228 - protein, 38 aa, Artificial Sequence
  Description of Artificial Sequence: Synthetic polypeptide
ADEEISTTNPVATEQYGQCVCSTWGEHNAEGFNSDTQS

SEQ ID NO: 199229 - protein, 36 aa, Artificial Sequence
  Description of Artificial Sequence: Synthetic polypeptide
DEMEIRTTNPVATEQYGCAIWCDASIIEDSESSQYE

SEQ ID NO: 199230 - protein, 36 aa, Artificial Sequence
  Description of Artificial Sequence: Synthetic polypeptide
NEDEIATTNPVAYEQWGTTVTDGGNHNGTTRGNDSV

SEQ ID NO: 199231 - protein, 38 aa, Artificial Sequence
  Description of Artificial Sequence: Synthetic polypeptide
QEEEICTTNPVAYEPYRGQSVVSINEGSTSPPGAPDRW

SEQ ID NO: 199232 - protein, 38 aa, Artificial Sequence
  Description of Artificial Sequence: Synthetic polypeptide
DEEAISTTNPVATEQYGCQVCSNWGEHNAENFNSETQS

SEQ ID NO: 199233 - protein, 34 aa, Artificial Sequence
  Description of Artificial Sequence: Synthetic polypeptide
DEAEIATTNPVSTEPWGCIAPEDLQQQQQPRNTH

SEQ ID NO: 199234 - protein, 34 aa, Artificial Sequence
  Description of Artificial Sequence: Synthetic polypeptide
SAEEIATTNPVATASWGCNVAGAGLNITAGGGNF

SEQ ID NO: 199235 - protein, 36 aa, Artificial Sequence
  Description of Artificial Sequence: Synthetic polypeptide
CEDEIATTNPVAYEQYGSCSAGPAIGQNHPMGMQMN

SEQ ID NO: 199236 - protein, 39 aa, Artificial Sequence
  Description of Artificial Sequence: Synthetic polypeptide
DEEEIRTTNPVATEQWGICQVCSYSGEDDNAENFNSDQA

SEQ ID NO: 199237 - protein, 39 aa, Artificial Sequence
  Description of Artificial Sequence: Synthetic polypeptide
DEEEIRTTNPVATEQWGICQVCSYSEDHNAENFNSDTQA

SEQ ID NO: 199238 - protein, 39 aa, Artificial Sequence
  Description of Artificial Sequence: Synthetic polypeptide
DENEIRTTNPVATEQYGASCMCSAGVDLLQEVVVQEDYN

SEQ ID NO: 199239 - protein, 35 aa, Artificial Sequence
  Description of Artificial Sequence: Synthetic polypeptide
SAEEIATTNPVATASWGCNVAGAGLQTAGGIGNFP

SEQ ID NO: 199240 - protein, 38 aa, Artificial Sequence
  Description of Artificial Sequence: Synthetic polypeptide
DEEAISTTNPVATEQYGCVCSNSGEDDNAENFNSETQA

SEQ ID NO: 199241 - protein, 36 aa, Artificial Sequence
  Description of Artificial Sequence: Synthetic polypeptide
DEEEISTTNPEATEQYGCVCPWMEHNAENFISDTQS

SEQ ID NO: 199242 - protein, 38 aa, Artificial Sequence
  Description of Artificial Sequence: Synthetic polypeptide
DEEAISTTNPVATEQYGCVCSNWEEAHNAENFNSDFQS

SEQ ID NO: 199243 - protein, 36 aa, Artificial Sequence
  Description of Artificial Sequence: Synthetic polypeptide
QEPEIATTNPVATEQYGVVDGPVEGEGGQGGGEEDT

SEQ ID NO: 199244 - protein, 34 aa, Artificial Sequence
  Description of Artificial Sequence: Synthetic polypeptide
SAEEIATTNPVATASWGCNVAGAGNQTAGENNFI

SEQ ID NO: 199245 - protein, 38 aa, Artificial Sequence
  Description of Artificial Sequence: Synthetic polypeptide
DEAEISTTNPVATEQYGQCVCGTSGEHNAENFNSDTQS

SEQ ID NO: 199246 - protein, 39 aa, Artificial Sequence
  Description of Artificial Sequence: Synthetic polypeptide
DEEEIRTTNPVATEQWGICQVCSNWMEDDNAENFGSDQA

SEQ ID NO: 199247 - protein, 38 aa, Artificial Sequence
  Description of Artificial Sequence: Synthetic polypeptide
DENEIRTTNPVATEQYGACCWWVADVDVEQLEGGEFHL

SEQ ID NO: 199248 - protein, 36 aa, Artificial Sequence
  Description of Artificial Sequence: Synthetic polypeptide
DDMEIRTTNPVATEGWGCVCSWGEDNAEYFGSDTQS

SEQ ID NO: 199249 - protein, 38 aa, Artificial Sequence
  Description of Artificial Sequence: Synthetic polypeptide
DEEAISTTNPVATEQYGCVCSNWGEDDNAENFNSDNQS

SEQ ID NO: 199250 - protein, 38 aa, Artificial Sequence
  Description of Artificial Sequence: Synthetic polypeptide
DEEAISTTNPVATEQYGCVCSNWGEDHNAENFNSDPQS

SEQ ID NO: 199251 - protein, 39 aa, Artificial Sequence
  Description of Artificial Sequence: Synthetic polypeptide
DEEEIRTTNPVATEQYGMMGYNTGSGNMDDIMDEGGTGT

SEQ ID NO: 199252 - protein, 38 aa, Artificial Sequence
  Description of Artificial Sequence: Synthetic polypeptide
DDEEIKTTNPVATEQYGSAGDNVEFGLGGDGDDTLTTM

SEQ ID NO: 199253 - protein, 38 aa, Artificial Sequence
  Description of Artificial Sequence: Synthetic polypeptide
DEEAISTTNPVATEQYGCVCSMWGEDHNQEYFNSETQA

SEQ ID NO: 199254 - protein, 39 aa, Artificial Sequence
  Description of Artificial Sequence: Synthetic polypeptide
VEGEIRTTNPVATDQYGSVNMNLIMQGQLQDEFNENNEQ

SEQ ID NO: 199255 - protein, 37 aa, Artificial Sequence
  Description of Artificial Sequence: Synthetic polypeptide
DDMEISTTNPVATEQYGCVCSNWGEPNEEFFGSDTQS

SEQ ID NO: 199256 - protein, 35 aa, Artificial Sequence
  Description of Artificial Sequence: Synthetic polypeptide
SEAEIASTNPVGYEAYGQVVMAYSPGLSQHVGAPR

SEQ ID NO: 199257 - protein, 37 aa, Artificial Sequence
  Description of Artificial Sequence: Synthetic polypeptide
DENHISTTNPVATEQYGSCPMPPMLWPENRSISQQGW

SEQ ID NO: 199258 - protein, 32 aa, Artificial Sequence
  Description of Artificial Sequence: Synthetic polypeptide
TESEIASTNPVGTEPWGVCAPTDRDQHNGDDA

SEQ ID NO: 199259 - protein, 37 aa, Artificial Sequence
  Description of Artificial Sequence: Synthetic polypeptide
DDMEISTTNPVATEQYGCICSNWGETNAENFGSDTQS

SEQ ID NO: 199260 - protein, 39 aa, Artificial Sequence
  Description of Artificial Sequence: Synthetic polypeptide
DESEIRGTNPVATEQYGAIISVGGQGNNNMNDGGNDQQL

SEQ ID NO: 199261 - protein, 35 aa, Artificial Sequence
  Description of Artificial Sequence: Synthetic polypeptide
DEAAIGTTNPVATEQYGCLCTATHGSPVEFETNKQ

SEQ ID NO: 199262 - protein, 36 aa, Artificial Sequence
  Description of Artificial Sequence: Synthetic polypeptide
DENKIRCTNPVAVEQYFGGSVDCPVGTTRFDSNGVP

SEQ ID NO: 199263 - protein, 38 aa, Artificial Sequence
  Description of Artificial Sequence: Synthetic polypeptide
CEEEISTTNPVAYEQYGQCVCSTWGEHNAENFGSDTQS

SEQ ID NO: 199264 - protein, 35 aa, Artificial Sequence
  Description of Artificial Sequence: Synthetic polypeptide
CEEEIACTNPVATEQYGSACNPADHQEAEDPAEDQ

SEQ ID NO: 199265 - protein, 39 aa, Artificial Sequence
  Description of Artificial Sequence: Synthetic polypeptide
DEEEIRTTNPVATEQWGICQVCSYWGEDHNAENFNSQQA

SEQ ID NO: 199266 - protein, 38 aa, Artificial Sequence
  Description of Artificial Sequence: Synthetic polypeptide
DESEIRGTNPVATEQYGAIIIVTGEGNNMNDGGNDQQL

SEQ ID NO: 199267 - protein, 36 aa, Artificial Sequence
  Description of Artificial Sequence: Synthetic polypeptide
DENEIATTNPVATEQYGSCAAAMGHGPADSGEGDTM

SEQ ID NO: 199268 - protein, 40 aa, Artificial Sequence
  Description of Artificial Sequence: Synthetic polypeptide
DEAEIRTTNPVAYEQGYGQVVCSEYLNDLLDAQSGQITKN

SEQ ID NO: 199269 - protein, 37 aa, Artificial Sequence
  Description of Artificial Sequence: Synthetic polypeptide
DEAAIGTTNPVATEQYGCFCSTWGEHNIENFNSDTQS

SEQ ID NO: 199270 - protein, 36 aa, Artificial Sequence
  Description of Artificial Sequence: Synthetic polypeptide
QEEEIATTNPVATEQWGCVAGNPGEDTATGWSDSHD

SEQ ID NO: 199271 - protein, 39 aa, Artificial Sequence
  Description of Artificial Sequence: Synthetic polypeptide
DEEEIRTTNPVATEQWGICQVCSYTGEDHNAENFISDQA

SEQ ID NO: 199272 - protein, 34 aa, Artificial Sequence
  Description of Artificial Sequence: Synthetic polypeptide
SAEEIATTNPVATASWGCNAGTNGLATAGPEDFQ

SEQ ID NO: 199273 - protein, 38 aa, Artificial Sequence
  Description of Artificial Sequence: Synthetic polypeptide
AEEEISTTNPVATEQYGQCVCSNWGEHNAENFISDNQS

SEQ ID NO: 199274 - protein, 39 aa, Artificial Sequence
  Description of Artificial Sequence: Synthetic polypeptide
FEEEIRTTNCVATEQYGDVDMNLTNNMTDQEFEFDGEEF

SEQ ID NO: 199275 - protein, 37 aa, Artificial Sequence
  Description of Artificial Sequence: Synthetic polypeptide
SAPEIRTTNPVATEQYGASAVVAWDVHHQEGQEDQEY

SEQ ID NO: 199276 - protein, 38 aa, Artificial Sequence
  Description of Artificial Sequence: Synthetic polypeptide
DEAEISTTNPVATEQYGQCVCSNWGEHNQENFGSDPQL

SEQ ID NO: 199277 - protein, 37 aa, Artificial Sequence
  Description of Artificial Sequence: Synthetic polypeptide
DEEEISCTNPVATEGYGCVCSNWGEHNAENFNSDNQS

SEQ ID NO: 199278 - protein, 38 aa, Artificial Sequence
  Description of Artificial Sequence: Synthetic polypeptide
FEDEIRTTNPAATEQYGSVVVVAGNNDGNQEGGEEQDQ

SEQ ID NO: 199279 - protein, 38 aa, Artificial Sequence
  Description of Artificial Sequence: Synthetic polypeptide
FEDEIRTTNCVATEQYGSVVVSGNMGEMGEEEGGQEQT

SEQ ID NO: 199280 - protein, 37 aa, Artificial Sequence
  Description of Artificial Sequence: Synthetic polypeptide
CDEAIRTTNPVATEQYGCVCSNWGPHNEENFNSDTQE

SEQ ID NO: 199281 - protein, 38 aa, Artificial Sequence
  Description of Artificial Sequence: Synthetic polypeptide
DEEEIGTTNPVAYEQYGQCVCSNWGEHNAENFNSDNQS

SEQ ID NO: 199282 - protein, 37 aa, Artificial Sequence
  Description of Artificial Sequence: Synthetic polypeptide
DEAEIACTNPVATEQYGSCAAAPGNHPMADMEIGNNP

SEQ ID NO: 199283 - protein, 36 aa, Artificial Sequence
  Description of Artificial Sequence: Synthetic polypeptide
DESEIRTTNPVAYEAWGISVPVNANSSSDVEGGMEC

SEQ ID NO: 199284 - protein, 38 aa, Artificial Sequence
  Description of Artificial Sequence: Synthetic polypeptide
DEAEISTTNPVATEQYGQCVCSNWGEHNQENFGSDTQA

SEQ ID NO: 199285 - protein, 37 aa, Artificial Sequence
  Description of Artificial Sequence: Synthetic polypeptide
DESEIRTTNPVAYEAWGISTVPNANSSSDREGGMTVC

SEQ ID NO: 199286 - protein, 36 aa, Artificial Sequence
  Description of Artificial Sequence: Synthetic polypeptide
CEEEIACTNPVATEQWGCNVAMTHLTNPDDGMGDHH

SEQ ID NO: 199287 - protein, 36 aa, Artificial Sequence
  Description of Artificial Sequence: Synthetic polypeptide
SDEEISTTNPVATCQYGCVCSWGEPNAEYFGSDTQA

SEQ ID NO: 199288 - protein, 37 aa, Artificial Sequence
  Description of Artificial Sequence: Synthetic polypeptide
DENAIRATNPVATEQYGTVTSLVWLPDEQENMQIDEI

SEQ ID NO: 199289 - protein, 37 aa, Artificial Sequence
  Description of Artificial Sequence: Synthetic polypeptide
DEAEIACTNPVATEQYGSCAAAGGNHPMAGMEIGTNT

SEQ ID NO: 199290 - protein, 35 aa, Artificial Sequence
  Description of Artificial Sequence: Synthetic polypeptide
DESEIRTTNPVAYEAWGICVPNARSSSDREGGMVC

SEQ ID NO: 199291 - protein, 38 aa, Artificial Sequence
  Description of Artificial Sequence: Synthetic polypeptide
DDEEISTTNPVATEQYGCVCSNWGEDHNAENFMSDNQS

SEQ ID NO: 199292 - protein, 37 aa, Artificial Sequence
  Description of Artificial Sequence: Synthetic polypeptide
DESEIRTTNPVAYEAWGISVPVNANNSSSDREIGMVC

SEQ ID NO: 199293 - protein, 34 aa, Artificial Sequence
  Description of Artificial Sequence: Synthetic polypeptide
AENCIATTNPVATEGYGCVCSWEPNQEHFISEQA

SEQ ID NO: 199294 - protein, 38 aa, Artificial Sequence
  Description of Artificial Sequence: Synthetic polypeptide
DEAEISTTNPVATEQYGQCVCSNWGEHNQEGFPSDFQS

SEQ ID NO: 199295 - protein, 39 aa, Artificial Sequence
  Description of Artificial Sequence: Synthetic polypeptide
DEEEIRTTNPVATEGYGICVCSNWEEDDNAENFISDNQA

SEQ ID NO: 199296 - protein, 37 aa, Artificial Sequence
  Description of Artificial Sequence: Synthetic polypeptide
SDEEIRTTNPVATEQYGCVCSNWGEHNAENFMSDTQS

SEQ ID NO: 199297 - protein, 38 aa, Artificial Sequence
  Description of Artificial Sequence: Synthetic polypeptide
DENEIRTTNPVATEGYGQCVCSNWGEDNIENFNSDTQS

SEQ ID NO: 199298 - protein, 38 aa, Artificial Sequence
  Description of Artificial Sequence: Synthetic polypeptide
DENEIRTTNPVATEGYGQCVCSWGEDHNQENFGSDTQS

SEQ ID NO: 199299 - protein, 38 aa, Artificial Sequence
  Description of Artificial Sequence: Synthetic polypeptide
DEAEISTTNPVATEQYGQCVCSNWGEHNAEYFNSDNQA

SEQ ID NO: 199300 - protein, 39 aa, Artificial Sequence
  Description of Artificial Sequence: Synthetic polypeptide
DEEEIRTTNPVATEQYGQCVCSNWGEDHNQENFISDTQA

SEQ ID NO: 199301 - protein, 38 aa, Artificial Sequence
  Description of Artificial Sequence: Synthetic polypeptide
SDEEIRTTNPVATEQYGQCVCSNWGEHNQENFNSDTQA

SEQ ID NO: 199302 - protein, 39 aa, Artificial Sequence
  Description of Artificial Sequence: Synthetic polypeptide
DEQEIRTTNPVATEQYGAVVMSNNDNNTEGPGQTDQTGD

SEQ ID NO: 199303 - protein, 38 aa, Artificial Sequence
  Description of Artificial Sequence: Synthetic polypeptide
DDEEISTTNPVATEQYGCVCSNWGEDHNAENFGSDTQS

SEQ ID NO: 199304 - protein, 38 aa, Artificial Sequence
  Description of Artificial Sequence: Synthetic polypeptide
DEAEISTTNPVATEQYGQCVCSNWGEHNAEYFNSETQA

SEQ ID NO: 199305 - protein, 39 aa, Artificial Sequence
  Description of Artificial Sequence: Synthetic polypeptide
DEEEIRTTNPVATEQYGSYAIAPLAVPLHEVSPMQDERN

SEQ ID NO: 199306 - protein, 37 aa, Artificial Sequence
  Description of Artificial Sequence: Synthetic polypeptide
SDEEIRTTNPVATHQYGCVCSMWGEDNAENFNSDTQS

SEQ ID NO: 199307 - protein, 37 aa, Artificial Sequence
  Description of Artificial Sequence: Synthetic polypeptide
DEEEISCTNPVATEGYGCVCSNWGEHNAENFNSETQS

SEQ ID NO: 199308 - protein, 38 aa, Artificial Sequence
  Description of Artificial Sequence: Synthetic polypeptide
DEAEISTTNPVATEQYGQCVCSNWGEHNIENFGSDTQS

SEQ ID NO: 199309 - protein, 38 aa, Artificial Sequence
  Description of Artificial Sequence: Synthetic polypeptide
DEAEISTTNPVATEQYGQCVCSNWGEHNIEYFNSDFQS

SEQ ID NO: 199310 - protein, 35 aa, Artificial Sequence
  Description of Artificial Sequence: Synthetic polypeptide
DEAEIACTNPVATEQWGGCVAGPTGSHQEPDMIEN

SEQ ID NO: 199311 - protein, 37 aa, Artificial Sequence
  Description of Artificial Sequence: Synthetic polypeptide
DEAEIACTNPVATEQYGSCAAAPGNHPMAGMEIGMNK

SEQ ID NO: 199312 - protein, 37 aa, Artificial Sequence
  Description of Artificial Sequence: Synthetic polypeptide
DEEEISCTNPVATEGYGCVCSNWGEHNAENFNSENQQ

SEQ ID NO: 199313 - protein, 36 aa, Artificial Sequence
  Description of Artificial Sequence: Synthetic polypeptide
CETEIACTNPVATEQYGCSSAANTHGPEANGNLEEN

SEQ ID NO: 199314 - protein, 39 aa, Artificial Sequence
  Description of Artificial Sequence: Synthetic polypeptide
DEEEIRTTNPVATEQYGSWDIPPCSVEEYAEVIGTPVDL

SEQ ID NO: 199315 - protein, 38 aa, Artificial Sequence
  Description of Artificial Sequence: Synthetic polypeptide
DDEEISTTNPVATEQYGCVCSNWGEDHNAENFNSDTQQ

SEQ ID NO: 199316 - protein, 32 aa, Artificial Sequence
  Description of Artificial Sequence: Synthetic polypeptide
DDSEVASTNPLSTEGYGNVAVNTYESDVGQTR

SEQ ID NO: 199317 - protein, 38 aa, Artificial Sequence
  Description of Artificial Sequence: Synthetic polypeptide
DEEEIACTNPVATEQYGSCAAAPGNGVPLEAMEHGHHE

SEQ ID NO: 199318 - protein, 38 aa, Artificial Sequence
  Description of Artificial Sequence: Synthetic polypeptide
DEEEIACTNPVATEQYGSCAAAPGNHPMAGMEIGNEVG

SEQ ID NO: 199319 - protein, 38 aa, Artificial Sequence
  Description of Artificial Sequence: Synthetic polypeptide
DEEEIACTNPVATEQYGSCAAAPGNHPMAGMEIGNVQT

SEQ ID NO: 199320 - protein, 35 aa, Artificial Sequence
  Description of Artificial Sequence: Synthetic polypeptide
TTGAEIATTNPVAYECWGIVSGGLNDDRQEGQNTV

SEQ ID NO: 199321 - protein, 38 aa, Artificial Sequence
  Description of Artificial Sequence: Synthetic polypeptide
DEEEIGTTNPVAYEQYGQCVCSNWGEHNAENFNSDTQA

SEQ ID NO: 199322 - protein, 36 aa, Artificial Sequence
  Description of Artificial Sequence: Synthetic polypeptide
CEEEIACTNPVAYEQWGCVAGNGQDGPARLEHAEHQ

SEQ ID NO: 199323 - protein, 37 aa, Artificial Sequence
  Description of Artificial Sequence: Synthetic polypeptide
DEEEIACTNPVATEQYGSCAAAPGPHPMAGMEIGNEA

SEQ ID NO: 199324 - protein, 38 aa, Artificial Sequence
  Description of Artificial Sequence: Synthetic polypeptide
DEDEICTTNPVATEQYGDVVIMTQGGPEGMLINDIGIE

SEQ ID NO: 199325 - protein, 38 aa, Artificial Sequence
  Description of Artificial Sequence: Synthetic polypeptide
DDEEISTTNPVATEQYGCVCSNWGEDPNIENFNSETQA

SEQ ID NO: 199326 - protein, 36 aa, Artificial Sequence
  Description of Artificial Sequence: Synthetic polypeptide
TTGEEIATTNPVAYECWGIVCSGGLNDDRQEQGNHT

SEQ ID NO: 199327 - protein, 35 aa, Artificial Sequence
  Description of Artificial Sequence: Synthetic polypeptide
CEEEIACTNPVAYEQWGCVAGNGQDGPAALEHAME

SEQ ID NO: 199328 - protein, 37 aa, Artificial Sequence
  Description of Artificial Sequence: Synthetic polypeptide
VEDEIACTNPVATEQYGSACAANPELGQEHQDDDGAK

SEQ ID NO: 199329 - protein, 39 aa, Artificial Sequence
  Description of Artificial Sequence: Synthetic polypeptide
DEAEISTTNPVATEQYGQCVCSTWGEDHNAENFISDNQS

SEQ ID NO: 199330 - protein, 36 aa, Artificial Sequence
  Description of Artificial Sequence: Synthetic polypeptide
CAEEIATTNPVATEQYGCVAAGEGGHGNESGEEDGH

SEQ ID NO: 199331 - protein, 39 aa, Artificial Sequence
  Description of Artificial Sequence: Synthetic polypeptide
DEAEISTTNPVATEQYGQCVCSTWGEEHNQENFNSDNQA

SEQ ID NO: 199332 - protein, 38 aa, Artificial Sequence
  Description of Artificial Sequence: Synthetic polypeptide
DEAEISTTNPVATEQYGQCVCSTWGEHNAENFPSDTQS

SEQ ID NO: 199333 - protein, 37 aa, Artificial Sequence
  Description of Artificial Sequence: Synthetic polypeptide
VEDEIACTNPVATEQYGSACAANPELGQEHADDEGAH

SEQ ID NO: 199334 - protein, 37 aa, Artificial Sequence
  Description of Artificial Sequence: Synthetic polypeptide
DEECIRTTNPVATEGYGCVCQNWGEHNAENFNSDTQA

SEQ ID NO: 199335 - protein, 38 aa, Artificial Sequence
  Description of Artificial Sequence: Synthetic polypeptide
DEAEISTTNPVATEQYGQCVCSNWGEHNAENFPSDNQA

SEQ ID NO: 199336 - protein, 35 aa, Artificial Sequence
  Description of Artificial Sequence: Synthetic polypeptide
DEESIACTNPVATEQWGAVVCAQNPVNTAGDPTGS

SEQ ID NO: 199337 - protein, 38 aa, Artificial Sequence
  Description of Artificial Sequence: Synthetic polypeptide
CEEEIRCTNPVATEQYGQCVCSNWGEHNAENFNSDNQS

SEQ ID NO: 199338 - protein, 38 aa, Artificial Sequence
  Description of Artificial Sequence: Synthetic polypeptide
DDEEISTTNPVATEQYGCVCSNWGEDHNAENFNSDTQS

SEQ ID NO: 199339 - protein, 38 aa, Artificial Sequence
  Description of Artificial Sequence: Synthetic polypeptide
DDEEISTTNPVATEQYGCVCSNWGEDHNAEYFNSENQS

SEQ ID NO: 199340 - protein, 37 aa, Artificial Sequence
  Description of Artificial Sequence: Synthetic polypeptide
DEDEIRCTNPVATEGYGVVNNNDEFDEEDEDGGNQGN

SEQ ID NO: 199341 - protein, 37 aa, Artificial Sequence
  Description of Artificial Sequence: Synthetic polypeptide
SDEEISTTNPVATEQYGCVCSNWGEHNAENFNSDNQL

SEQ ID NO: 199342 - protein, 37 aa, Artificial Sequence
  Description of Artificial Sequence: Synthetic polypeptide
SDEEISTTNPVATEQYGCVCSNWGEHNQEHFNSENQA

SEQ ID NO: 199343 - protein, 34 aa, Artificial Sequence
  Description of Artificial Sequence: Synthetic polypeptide
AQQEIATTNPVAYEQYGCVAGNGDATMPMGDTHW

SEQ ID NO: 199344 - protein, 38 aa, Artificial Sequence
  Description of Artificial Sequence: Synthetic polypeptide
CEEEIRCTNPVATEQYGQCVCSWGEDHNQENFNSDNQA

SEQ ID NO: 199345 - protein, 37 aa, Artificial Sequence
  Description of Artificial Sequence: Synthetic polypeptide
VEDEIACTNPVATEQYGSACATNPELGQGHADIQDAH

SEQ ID NO: 199346 - protein, 38 aa, Artificial Sequence
  Description of Artificial Sequence: Synthetic polypeptide
DEAEISTTNPVATEQYGQCVCSNWGEHNTESFNSDTQM

SEQ ID NO: 199347 - protein, 38 aa, Artificial Sequence
  Description of Artificial Sequence: Synthetic polypeptide
DEEEIACTNPVATEQYGSCAAAAGEGVPLEAMEHGHNH

SEQ ID NO: 199348 - protein, 38 aa, Artificial Sequence
  Description of Artificial Sequence: Synthetic polypeptide
DDEEISTTNPVATEQYGCVCSNWGEDHNIENFNSDTQA

SEQ ID NO: 199349 - protein, 38 aa, Artificial Sequence
  Description of Artificial Sequence: Synthetic polypeptide
DEEEIACTNPVATEQYGSCAAAAGNGPPLEAMEHGHHA

SEQ ID NO: 199350 - protein, 37 aa, Artificial Sequence
  Description of Artificial Sequence: Synthetic polypeptide
VEDEIACTNPVATEQYGSACATNPELGQEHQDDQDAH

SEQ ID NO: 199351 - protein, 38 aa, Artificial Sequence
  Description of Artificial Sequence: Synthetic polypeptide
DDECIRTTNPVATEQWGCVTSNWGEDHNQENFGSDNAS

SEQ ID NO: 199352 - protein, 37 aa, Artificial Sequence
  Description of Artificial Sequence: Synthetic polypeptide
VEDEIACTNPVATEQYGSACAATNGQEVNDDGMGDDH

SEQ ID NO: 199353 - protein, 38 aa, Artificial Sequence
  Description of Artificial Sequence: Synthetic polypeptide
CEEEIRCTNPVATEQYGQCVCSNWGEHNIENFNSDNQA

SEQ ID NO: 199354 - protein, 37 aa, Artificial Sequence
  Description of Artificial Sequence: Synthetic polypeptide
CETEIACTNPVATEQWGSVSGPAIAPPQAAGNPPEQD

SEQ ID NO: 199355 - protein, 37 aa, Artificial Sequence
  Description of Artificial Sequence: Synthetic polypeptide
VEDEIACTNPVATEQYGSACAANPELGQLHQDDQGAH

SEQ ID NO: 199356 - protein, 35 aa, Artificial Sequence
  Description of Artificial Sequence: Synthetic polypeptide
TTNEEATTNPVAYEQWGSVAWTEIDTQDGQGDNIK

SEQ ID NO: 199357 - protein, 37 aa, Artificial Sequence
  Description of Artificial Sequence: Synthetic polypeptide
QEQEIATTNPVATEQYGVVMAGPGEDEGGQDGDENEF

SEQ ID NO: 199358 - protein, 37 aa, Artificial Sequence
  Description of Artificial Sequence: Synthetic polypeptide
CEEEIATTNPVATEQWGGCCTAAAGGHLDNGMHNYHN

SEQ ID NO: 199359 - protein, 38 aa, Artificial Sequence
  Description of Artificial Sequence: Synthetic polypeptide
DDEEISTTNPVATEQYGCVCSNWGEDDNAENFNSETQS

SEQ ID NO: 199360 - protein, 38 aa, Artificial Sequence
  Description of Artificial Sequence: Synthetic polypeptide
AEEEISTTNPVATEQYGQCVCSNWGEHNQEHFNSDTQS

SEQ ID NO: 199361 - protein, 34 aa, Artificial Sequence
  Description of Artificial Sequence: Synthetic polypeptide
AEAEIACTNPVGTEGYGVSCGSGEHNAHFGSDQS

SEQ ID NO: 199362 - protein, 36 aa, Artificial Sequence
  Description of Artificial Sequence: Synthetic polypeptide
DEDEIRGTNCVATEAWGCVSAINGEGGDGEGEEMNN

SEQ ID NO: 199363 - protein, 38 aa, Artificial Sequence
  Description of Artificial Sequence: Synthetic polypeptide
DEEEIACTNPVATEQYGSACPGANPAEEAGAHQANGAP

SEQ ID NO: 199364 - protein, 38 aa, Artificial Sequence
  Description of Artificial Sequence: Synthetic polypeptide
AEEEISTTNPVATEQYGQCVCSNWGEHNQENFGSDTQS

SEQ ID NO: 199365 - protein, 37 aa, Artificial Sequence
  Description of Artificial Sequence: Synthetic polypeptide
FEEEIATTNCVATEQYGVVAGPGEGEMGQGGNEGEDT

SEQ ID NO: 199366 - protein, 38 aa, Artificial Sequence
  Description of Artificial Sequence: Synthetic polypeptide
DEECIRCTNPVATEQYGQCVCSNWGEHNQENFNSENQL

SEQ ID NO: 199367 - protein, 36 aa, Artificial Sequence
  Description of Artificial Sequence: Synthetic polypeptide
DEDEIRGTNCVATEAWGCVSAINGEGGDGEGEDNET

SEQ ID NO: 199368 - protein, 36 aa, Artificial Sequence
  Description of Artificial Sequence: Synthetic polypeptide
DEDEIRGTNCVATDAWGSVSAINGEGGDGEGEQNQS

SEQ ID NO: 199369 - protein, 34 aa, Artificial Sequence
  Description of Artificial Sequence: Synthetic polypeptide
DEESIACTNPVATASWGCVAGTGENHGPDDSNMQ

SEQ ID NO: 199370 - protein, 34 aa, Artificial Sequence
  Description of Artificial Sequence: Synthetic polypeptide
DEESIACTNPVATASWGCVAGTGENPNPDDSNMD

SEQ ID NO: 199371 - protein, 38 aa, Artificial Sequence
  Description of Artificial Sequence: Synthetic polypeptide
DENEIRTTNPVATEGYGCVCSNWGEAHNQENFNSDTQA

SEQ ID NO: 199372 - protein, 38 aa, Artificial Sequence
  Description of Artificial Sequence: Synthetic polypeptide
DDEEISTTNPVATEQYGCVCSNWGEDHNAEFFNSDTQS

SEQ ID NO: 199373 - protein, 35 aa, Artificial Sequence
  Description of Artificial Sequence: Synthetic polypeptide
AENEEIATTNPVAYESWGCVCTIDSNDRNDQNSEE

SEQ ID NO: 199374 - protein, 38 aa, Artificial Sequence
  Description of Artificial Sequence: Synthetic polypeptide
DEEEIGTTNPVAYEQYGQCVCSNSGEHNAENFNSDTQS

SEQ ID NO: 199375 - protein, 36 aa, Artificial Sequence
  Description of Artificial Sequence: Synthetic polypeptide
DEDEIRGTNCVATEAWGCVSAILGEGGDGEGEGNQT

SEQ ID NO: 199376 - protein, 37 aa, Artificial Sequence
  Description of Artificial Sequence: Synthetic polypeptide
AEECIRTTNPVAYEQYGCVCSNWGEHNAEYFNSDTQS

SEQ ID NO: 199377 - protein, 36 aa, Artificial Sequence
  Description of Artificial Sequence: Synthetic polypeptide
DEDEIRGTNCVATEAWGCVSAINGEGGDGEGEENQI

SEQ ID NO: 199378 - protein, 39 aa, Artificial Sequence
  Description of Artificial Sequence: Synthetic polypeptide
DEECIRCTNPVATEQYGQCQVCSNWGEDNAENFGSDNQS

SEQ ID NO: 199379 - protein, 35 aa, Artificial Sequence
  Description of Artificial Sequence: Synthetic polypeptide
DEHEIRTTNPVAYECWGTVYRINENFDIQMKTDGP

SEQ ID NO: 199380 - protein, 38 aa, Artificial Sequence
  Description of Artificial Sequence: Synthetic polypeptide
DEECIRCTNPVATEQYGCVCSNWGELDNAENFNSDTQS

SEQ ID NO: 199381 - protein, 33 aa, Artificial Sequence
  Description of Artificial Sequence: Synthetic polypeptide
TTAENATTNPCAYECWGSVSGGLNDDRQHQNND

SEQ ID NO: 199382 - protein, 38 aa, Artificial Sequence
  Description of Artificial Sequence: Synthetic polypeptide
DEECIRTTNPVATEQYGCVCSNWGEDHNDENFMSDTQS

SEQ ID NO: 199383 - protein, 38 aa, Artificial Sequence
  Description of Artificial Sequence: Synthetic polypeptide
DEECIRTTNPVATEQYGCVCSNWGEDHEIENFNSETQN

SEQ ID NO: 199384 - protein, 36 aa, Artificial Sequence
  Description of Artificial Sequence: Synthetic polypeptide
CEEEIACTNPVATEQWGCNVAMTALTNPDDGMGDMW

SEQ ID NO: 199385 - protein, 37 aa, Artificial Sequence
  Description of Artificial Sequence: Synthetic polypeptide
DENAINTTNPVATTEYYCSVSDSNNPLYEPLGELMTM

SEQ ID NO: 199386 - protein, 32 aa, Artificial Sequence
  Description of Artificial Sequence: Synthetic polypeptide
VEDEIACTNPVAYEQWGCVAGEGGASNDDPQH

SEQ ID NO: 199387 - protein, 37 aa, Artificial Sequence
  Description of Artificial Sequence: Synthetic polypeptide
SEEEIHTTNPVATEGYGMVINGQGTGQGEGGDEQNGE

SEQ ID NO: 199388 - protein, 34 aa, Artificial Sequence
  Description of Artificial Sequence: Synthetic polypeptide
TTDEIASVNPVCYEPYGVTVNTINLSQAAGGNNV

SEQ ID NO: 199389 - protein, 35 aa, Artificial Sequence
  Description of Artificial Sequence: Synthetic polypeptide
DEHEIRTTNPVAYECWGTVYRINENFDRQMDTDGG

SEQ ID NO: 199390 - protein, 33 aa, Artificial Sequence
  Description of Artificial Sequence: Synthetic polypeptide
AEAEIACTNPVGYEAYGVVMAYSPGLSEHVGDI

SEQ ID NO: 199391 - protein, 37 aa, Artificial Sequence
  Description of Artificial Sequence: Synthetic polypeptide
DEECIRCTNPVATEQYGCVCSWGEDDNIENFISDTQS

SEQ ID NO: 199392 - protein, 36 aa, Artificial Sequence
  Description of Artificial Sequence: Synthetic polypeptide
DENEIRTTNPVATEGWGCVTSWGEDNTEYFISDTAS

SEQ ID NO: 199393 - protein, 34 aa, Artificial Sequence
  Description of Artificial Sequence: Synthetic polypeptide
DEESIACTNPVATASWGCVAGTGENGPDDSNSMV

SEQ ID NO: 199394 - protein, 36 aa, Artificial Sequence
  Description of Artificial Sequence: Synthetic polypeptide
DEDEIRGTNCVATEAWGCVSAINGEGGDGEGGQNQT

SEQ ID NO: 199395 - protein, 36 aa, Artificial Sequence
  Description of Artificial Sequence: Synthetic polypeptide
DDECIGTTNPVATEQYGCVCSNWGEHNQENFISDQA

SEQ ID NO: 199396 - protein, 38 aa, Artificial Sequence
  Description of Artificial Sequence: Synthetic polypeptide
DENEIRTTNPVATEGYGCVCSNWGEDHNAENFNSDNQA

SEQ ID NO: 199397 - protein, 38 aa, Artificial Sequence
  Description of Artificial Sequence: Synthetic polypeptide
DENEIRTTNPVATEGYGCVCSNWGEDINAENFNSDTQA

SEQ ID NO: 199398 - protein, 37 aa, Artificial Sequence
  Description of Artificial Sequence: Synthetic polypeptide
TTEEIRGTNPVATEFYGSVVIDEGEQGIQGNGEGQGQ

SEQ ID NO: 199399 - protein, 39 aa, Artificial Sequence
  Description of Artificial Sequence: Synthetic polypeptide
DEAEISTTNPVATEQYGQCVCSNWGEDHNTENFGSENQA

SEQ ID NO: 199400 - protein, 38 aa, Artificial Sequence
  Description of Artificial Sequence: Synthetic polypeptide
DEAEISTTNPVATEQYGQCVCSNWGEHNAEGFNSDTQS

SEQ ID NO: 199401 - protein, 38 aa, Artificial Sequence
  Description of Artificial Sequence: Synthetic polypeptide
DEAEISTTNPVATEQYGQCVCSNWGEHNAENFGSDTQS

SEQ ID NO: 199402 - protein, 38 aa, Artificial Sequence
  Description of Artificial Sequence: Synthetic polypeptide
DEAEISTTNPVATEQYGQCVCSNWGEHNAENFGSETQA

SEQ ID NO: 199403 - protein, 38 aa, Artificial Sequence
  Description of Artificial Sequence: Synthetic polypeptide
DEREISTTNPVATEQYGQCVCPNWGEHNQENFNSDTQA

SEQ ID NO: 199404 - protein, 38 aa, Artificial Sequence
  Description of Artificial Sequence: Synthetic polypeptide
DDEEISTTNPVATEQYGCVCSNWGEDHNAEGFGSETQG

SEQ ID NO: 199405 - protein, 38 aa, Artificial Sequence
  Description of Artificial Sequence: Synthetic polypeptide
DDEEISTTNPVATEQYGCVCSNWGEDHNAEGFNSDTQA

SEQ ID NO: 199406 - protein, 40 aa, Artificial Sequence
  Description of Artificial Sequence: Synthetic polypeptide
DEEEIRTTNPVATEAYGTVTTVVGNSDEIGTTSISTEGNT

SEQ ID NO: 199407 - protein, 38 aa, Artificial Sequence
  Description of Artificial Sequence: Synthetic polypeptide
DDEEISTTNPVATEQYGCVCSNWGEDHNAEHFNSDNQA

SEQ ID NO: 199408 - protein, 38 aa, Artificial Sequence
  Description of Artificial Sequence: Synthetic polypeptide
DEEEIRTTNPVATEGYGICVCSSVEDHNQENFISQTQS

SEQ ID NO: 199409 - protein, 38 aa, Artificial Sequence
  Description of Artificial Sequence: Synthetic polypeptide
DEAEISTTNPVATEQYGQCVCSNWGEHNAENFNSDTQA

SEQ ID NO: 199410 - protein, 38 aa, Artificial Sequence
  Description of Artificial Sequence: Synthetic polypeptide
DEAEISTTNPVATEQYGQCVCSNWGEHNAENFNSDTQS

SEQ ID NO: 199411 - protein, 37 aa, Artificial Sequence
  Description of Artificial Sequence: Synthetic polypeptide
CEEEIATTNPVATEQWGGCCTAAAGTHLDNGMAHNNH

SEQ ID NO: 199412 - protein, 38 aa, Artificial Sequence
  Description of Artificial Sequence: Synthetic polypeptide
DEEEISCTNPVATEQYGCVCSDWGEDHNAENFNSDNQS

SEQ ID NO: 199413 - protein, 38 aa, Artificial Sequence
  Description of Artificial Sequence: Synthetic polypeptide
CEEEIATTNPVATEQWGGCCTAAAGNHLDDGMAHSNGH

SEQ ID NO: 199414 - protein, 36 aa, Artificial Sequence
  Description of Artificial Sequence: Synthetic polypeptide
DEECISTTNPVATEGYGCVCGWGEAPNQEYFGSDQS

SEQ ID NO: 199415 - protein, 36 aa, Artificial Sequence
  Description of Artificial Sequence: Synthetic polypeptide
VEDEIACTNPVATEQYGSVCAAPDGLENNDDLGAQE

SEQ ID NO: 199416 - protein, 38 aa, Artificial Sequence
  Description of Artificial Sequence: Synthetic polypeptide
SDEEIRTTNPVATEQYGCVCSNWGEDHNAENFNSDFQA

SEQ ID NO: 199417 - protein, 38 aa, Artificial Sequence
  Description of Artificial Sequence: Synthetic polypeptide
DEECISTTNPVATEGYGCVCNNWGEAPNQEYFGSDNQS

SEQ ID NO: 199418 - protein, 37 aa, Artificial Sequence
  Description of Artificial Sequence: Synthetic polypeptide
DEEEISCTNPVATEQYGCVCGNWGEHNAENFNSENQA

SEQ ID NO: 199419 - protein, 37 aa, Artificial Sequence
  Description of Artificial Sequence: Synthetic polypeptide
VEDEIACTNPVATEQYGSVCAMANPAEDQDDPLNNHQ

SEQ ID NO: 199420 - protein, 33 aa, Artificial Sequence
  Description of Artificial Sequence: Synthetic polypeptide
DDSEVATTNPVSTEGWGATANNEDWQSPVGPYR

SEQ ID NO: 199421 - protein, 38 aa, Artificial Sequence
  Description of Artificial Sequence: Synthetic polypeptide
DEAEISTTNPVATEQYGQCVCSNWGEDNAENFNSDFQS

SEQ ID NO: 199422 - protein, 38 aa, Artificial Sequence
  Description of Artificial Sequence: Synthetic polypeptide
DEAEISTTNPVATEQYGQCVCSNWGEDNAENFNSDNQS

SEQ ID NO: 199423 - protein, 38 aa, Artificial Sequence
  Description of Artificial Sequence: Synthetic polypeptide
DEAEISTTNPVATEQYGQCVCSNWGEDNQENFNSDTQL

SEQ ID NO: 199424 - protein, 38 aa, Artificial Sequence
  Description of Artificial Sequence: Synthetic polypeptide
DEAEISTTNPVATEQYGQCVCSNWGEDNQENFNSETQA

SEQ ID NO: 199425 - protein, 38 aa, Artificial Sequence
  Description of Artificial Sequence: Synthetic polypeptide
AEEEISTTNPVATEQYGQCVCSNWGEHNTENFNSDTQQ

SEQ ID NO: 199426 - protein, 36 aa, Artificial Sequence
  Description of Artificial Sequence: Synthetic polypeptide
DEAEIRTTNPVAYECWGVVCYTTPDKQDGKGQDGDN

SEQ ID NO: 199427 - protein, 36 aa, Artificial Sequence
  Description of Artificial Sequence: Synthetic polypeptide
VEDEIACTNPVAYEPYGSVCSAPNLGTEHQGDIQAM

SEQ ID NO: 199428 - protein, 34 aa, Artificial Sequence
  Description of Artificial Sequence: Synthetic polypeptide
AEAEIACTNPVGTEGYGVSCGSEHNQEHFGSDQS

SEQ ID NO: 199429 - protein, 37 aa, Artificial Sequence
  Description of Artificial Sequence: Synthetic polypeptide
DENEIRTTNPVATEGYGCVCSNWGEHNEENFSSDTQA

SEQ ID NO: 199430 - protein, 36 aa, Artificial Sequence
  Description of Artificial Sequence: Synthetic polypeptide
CDEAISTTNPVATEQYGCVCSWGEHNAENFNSDFQS

SEQ ID NO: 199431 - protein, 37 aa, Artificial Sequence
  Description of Artificial Sequence: Synthetic polypeptide
SDEEIRTTNPVATCQYGQCVCSWMEDNAENFGSDTQS

SEQ ID NO: 199432 - protein, 37 aa, Artificial Sequence
  Description of Artificial Sequence: Synthetic polypeptide
DEEEISCTNPVATEQYGCVCSMWGEDNQEYFISDTQA

SEQ ID NO: 199433 - protein, 39 aa, Artificial Sequence
  Description of Artificial Sequence: Synthetic polypeptide
DEEEIRTTNPVATEQYGQCVCSNWGEDHDQENFISDTQA

SEQ ID NO: 199434 - protein, 36 aa, Artificial Sequence
  Description of Artificial Sequence: Synthetic polypeptide
DESEIRTTNPVAYEAWGISVSECAPSSSDPEGGMVG

SEQ ID NO: 199435 - protein, 37 aa, Artificial Sequence
  Description of Artificial Sequence: Synthetic polypeptide
SDEEIRTTNPVATEGWGCVCSNWGEHNAENFGSDNQA

SEQ ID NO: 199436 - protein, 37 aa, Artificial Sequence
  Description of Artificial Sequence: Synthetic polypeptide
SDEEIRTTNPVATEGYGCVCSNWGEHNAEHFNSDTQA

SEQ ID NO: 199437 - protein, 37 aa, Artificial Sequence
  Description of Artificial Sequence: Synthetic polypeptide
SDEEIRTTNPVATEGYGCVCSNWGEHNAENFGSDTQS

SEQ ID NO: 199438 - protein, 37 aa, Artificial Sequence
  Description of Artificial Sequence: Synthetic polypeptide
DEAEIACTNPVATEQYGSCAAAPGNHPMAGMEIGNAD

SEQ ID NO: 199439 - protein, 38 aa, Artificial Sequence
  Description of Artificial Sequence: Synthetic polypeptide
DEAEISTTNPVATEQYGQCVCSWGEDHNAENFNSDTQS

SEQ ID NO: 199440 - protein, 35 aa, Artificial Sequence
  Description of Artificial Sequence: Synthetic polypeptide
TTTAEIATTNPVAYECWGSVSGGLNDDRQEQHNHP

SEQ ID NO: 199441 - protein, 35 aa, Artificial Sequence
  Description of Artificial Sequence: Synthetic polypeptide
TTTEEATTNPVAYEQWGSVAWTEIDTQSGGQGDNI

SEQ ID NO: 199442 - protein, 35 aa, Artificial Sequence
  Description of Artificial Sequence: Synthetic polypeptide
VEDEIACTNPVATEQWGGCVAGTMGLQHSDDPMPM

SEQ ID NO: 199443 - protein, 36 aa, Artificial Sequence
  Description of Artificial Sequence: Synthetic polypeptide
SEEEIRCTNPCATEQYGCVCSWGEDNAENFISDPQS

SEQ ID NO: 199444 - protein, 36 aa, Artificial Sequence
  Description of Artificial Sequence: Synthetic polypeptide
SEEEIRCTNPCATEQYGCVCSWGEDHNANFISDTQA

SEQ ID NO: 199445 - protein, 38 aa, Artificial Sequence
  Description of Artificial Sequence: Synthetic polypeptide
DEECIRTTNPVATEIYGQCVCGTWGEHNQENFGSDTQA

SEQ ID NO: 199446 - protein, 35 aa, Artificial Sequence
  Description of Artificial Sequence: Synthetic polypeptide
VEDEIACTNPVATEQWGGCVAGTMLEEHSDDNMPE

SEQ ID NO: 199447 - protein, 33 aa, Artificial Sequence
  Description of Artificial Sequence: Synthetic polypeptide
DENEIATTNPCSYMPYGTTSMEDWDQQQQNGNH

SEQ ID NO: 199448 - protein, 39 aa, Artificial Sequence
  Description of Artificial Sequence: Synthetic polypeptide
DEEEIRTTNPVAYEQYGQCVCSNSGEDDNAENFNSDNQS

SEQ ID NO: 199449 - protein, 35 aa, Artificial Sequence
  Description of Artificial Sequence: Synthetic polypeptide
DEMEIVTTNPIATEQWGATVWAAAEGPAEPEGNYI

SEQ ID NO: 199450 - protein, 36 aa, Artificial Sequence
  Description of Artificial Sequence: Synthetic polypeptide
VEDEIACTNPVATEQWGGCVANNNGLENGMQENDFQ

SEQ ID NO: 199451 - protein, 35 aa, Artificial Sequence
  Description of Artificial Sequence: Synthetic polypeptide
SEAAEIATTNPVAYEAWGVVWPGPNNENDGQSGSR

SEQ ID NO: 199452 - protein, 36 aa, Artificial Sequence
  Description of Artificial Sequence: Synthetic polypeptide
VEDEIACTNPVATEQWGGCVFANNHLENGMMQENDF

SEQ ID NO: 199453 - protein, 39 aa, Artificial Sequence
  Description of Artificial Sequence: Synthetic polypeptide
QEEEIRSTNPVATESYGAVITMQTNNEGQGQEQREEENN

SEQ ID NO: 199454 - protein, 38 aa, Artificial Sequence
  Description of Artificial Sequence: Synthetic polypeptide
SEEEIRCTNPCATEQYGCVCSNWGEPDNAEHFGSDNQS

SEQ ID NO: 199455 - protein, 36 aa, Artificial Sequence
  Description of Artificial Sequence: Synthetic polypeptide
SEEEIRCTNPCATEQYGCVCSNWGEHNANFISQTQS

SEQ ID NO: 199456 - protein, 36 aa, Artificial Sequence
  Description of Artificial Sequence: Synthetic polypeptide
SEEEIRCTNPCATEQYGCVCSNWGEHNAEYFSSDQS

SEQ ID NO: 199457 - protein, 39 aa, Artificial Sequence
  Description of Artificial Sequence: Synthetic polypeptide
DEMEIRTTNPVATCQYGQCVCSTWGEDDNEENFNSDTQA

SEQ ID NO: 199458 - protein, 39 aa, Artificial Sequence
  Description of Artificial Sequence: Synthetic polypeptide
DEEEIRTTNPVAYEQYGSTVCAVGEAGGATARGSDISAM

SEQ ID NO: 199459 - protein, 38 aa, Artificial Sequence
  Description of Artificial Sequence: Synthetic polypeptide
DEKEICTTNPVATEFYGAVINMQANQEGQGEQGEEENN

SEQ ID NO: 199460 - protein, 38 aa, Artificial Sequence
  Description of Artificial Sequence: Synthetic polypeptide
AEEEISTTNPVATEQYGQCVCSNWMEHNAENFNSDTQA

SEQ ID NO: 199461 - protein, 35 aa, Artificial Sequence
  Description of Artificial Sequence: Synthetic polypeptide
DEMEIVTTNPIATEQWGATTWANAEDPAEPEGNYI

SEQ ID NO: 199462 - protein, 37 aa, Artificial Sequence
  Description of Artificial Sequence: Synthetic polypeptide
FDEEISTTNPVATEQYGCVCSNWGEHNQENFNSDFQP

SEQ ID NO: 199463 - protein, 39 aa, Artificial Sequence
  Description of Artificial Sequence: Synthetic polypeptide
DEEEIRGTNPVATEQYGVVVVNQNMPNQGQEGGQTGGQG

SEQ ID NO: 199464 - protein, 39 aa, Artificial Sequence
  Description of Artificial Sequence: Synthetic polypeptide
DEGEIRTTNPVATEQYGYCWSGPTLLALNIPQHSDEDDS

SEQ ID NO: 199465 - protein, 37 aa, Artificial Sequence
  Description of Artificial Sequence: Synthetic polypeptide
CEEEIACTNPVATEQWGCSNATIGAHTNPEDQTEGRI

SEQ ID NO: 199466 - protein, 38 aa, Artificial Sequence
  Description of Artificial Sequence: Synthetic polypeptide
AEMEIATTNPVATEQYGQCVCSTWGEHNEEHFNSETQA

SEQ ID NO: 199467 - protein, 35 aa, Artificial Sequence
  Description of Artificial Sequence: Synthetic polypeptide
VEDEIACTNPVATEQWGGCVAATANGMGMGPGGTE

SEQ ID NO: 199468 - protein, 37 aa, Artificial Sequence
  Description of Artificial Sequence: Synthetic polypeptide
DEAEISTTNPVATEQYGQCVCSWGEHNQENFISDTQS

SEQ ID NO: 199469 - protein, 37 aa, Artificial Sequence
  Description of Artificial Sequence: Synthetic polypeptide
DEAEISTTNPVATEQYGQCVCSWGEHNQENFISETQS

SEQ ID NO: 199470 - protein, 34 aa, Artificial Sequence
  Description of Artificial Sequence: Synthetic polypeptide
VEDEIACTNPVATEQWGGCVAATANHMNMAPEGT

SEQ ID NO: 199471 - protein, 38 aa, Artificial Sequence
  Description of Artificial Sequence: Synthetic polypeptide
CEEEIACTNPVATEQWGCSVNTPGQDNPITALDEMENY

SEQ ID NO: 199472 - protein, 38 aa, Artificial Sequence
  Description of Artificial Sequence: Synthetic polypeptide
QEEEIRSTNPVATEQYGAVVSSGGGQIGQGGGPEQTQQ

SEQ ID NO: 199473 - protein, 35 aa, Artificial Sequence
  Description of Artificial Sequence: Synthetic polypeptide
AEAEIACTNPCSYEQYGCVCSWELNQESFGSENQA

SEQ ID NO: 199474 - protein, 38 aa, Artificial Sequence
  Description of Artificial Sequence: Synthetic polypeptide
DEAEISTTNPVATEQYGSCPMPIPMLWPENRSISQQTS

SEQ ID NO: 199475 - protein, 35 aa, Artificial Sequence
  Description of Artificial Sequence: Synthetic polypeptide
VEDEIACTNPVATEQWGGCVAGTGLAEAPMDNGQL

SEQ ID NO: 199476 - protein, 38 aa, Artificial Sequence
  Description of Artificial Sequence: Synthetic polypeptide
AEEEISTTNPVATEQYGQCVCSNWGYHNAENFNSDTQA

SEQ ID NO: 199477 - protein, 38 aa, Artificial Sequence
  Description of Artificial Sequence: Synthetic polypeptide
DEAEIRTTNPVATEQYGCANWEAENPDDLGGSGQEEIG

SEQ ID NO: 199478 - protein, 37 aa, Artificial Sequence
  Description of Artificial Sequence: Synthetic polypeptide
DEECIRTTNPVATEIYGCVCQWGEDHNAENFNSDTQA

SEQ ID NO: 199479 - protein, 36 aa, Artificial Sequence
  Description of Artificial Sequence: Synthetic polypeptide
VEDEIACTNPVATEQWGSVSAAAPADADTPQGNDMQ

SEQ ID NO: 199480 - protein, 38 aa, Artificial Sequence
  Description of Artificial Sequence: Synthetic polypeptide
DEQEIATTNPVATEQWGGCTTAGNNGENATMQGDGMNP

SEQ ID NO: 199481 - protein, 35 aa, Artificial Sequence
  Description of Artificial Sequence: Synthetic polypeptide
DEMEIVTTNPIATEQWGTTVWAAAEGPEEPEGNYI

SEQ ID NO: 199482 - protein, 36 aa, Artificial Sequence
  Description of Artificial Sequence: Synthetic polypeptide
DENEIATTNPTAYEQWGATYYSIEHEMNQREMDGYR

SEQ ID NO: 199483 - protein, 39 aa, Artificial Sequence
  Description of Artificial Sequence: Synthetic polypeptide
DEEEIRTTNPVAYEQYGSTVCAVGEAGGTQASPGDEMAM

SEQ ID NO: 199484 - protein, 36 aa, Artificial Sequence
  Description of Artificial Sequence: Synthetic polypeptide
CETEIACTNPVATEQWGCVAGTGPFVQTAENAGMNS

SEQ ID NO: 199485 - protein, 35 aa, Artificial Sequence
  Description of Artificial Sequence: Synthetic polypeptide
CETEIACTNPVATEQWGCVAGTENEEAGPGEEDAW

SEQ ID NO: 199486 - protein, 37 aa, Artificial Sequence
  Description of Artificial Sequence: Synthetic polypeptide
VEDEIACTNPVATEQYGCVAAIANAGTNAAAGNDNSM

SEQ ID NO: 199487 - protein, 35 aa, Artificial Sequence
  Description of Artificial Sequence: Synthetic polypeptide
VEDEIACTNPVATEQYGCVAANNGDTADSMADGDE

SEQ ID NO: 199488 - protein, 36 aa, Artificial Sequence
  Description of Artificial Sequence: Synthetic polypeptide
VEDEIACTNPVATEQYGCVAANNPGGQAHQGDIEAP

SEQ ID NO: 199489 - protein, 36 aa, Artificial Sequence
  Description of Artificial Sequence: Synthetic polypeptide
SEACIRCTNPCATEQYGCVCSWGEHNAENFGSDNQS

SEQ ID NO: 199490 - protein, 38 aa, Artificial Sequence
  Description of Artificial Sequence: Synthetic polypeptide
DEREISTTNPVATEQYGCVCSNWGEDHNAEYFNSENQS

SEQ ID NO: 199491 - protein, 38 aa, Artificial Sequence
  Description of Artificial Sequence: Synthetic polypeptide
DEEEIATTNPVATEQWGCNIGAGNNGGLPEENNHGTNQ

SEQ ID NO: 199492 - protein, 38 aa, Artificial Sequence
  Description of Artificial Sequence: Synthetic polypeptide
DEMEIRTTNPVATCQYGQCVCGTWGEHNQENFGSDTQS

SEQ ID NO: 199493 - protein, 38 aa, Artificial Sequence
  Description of Artificial Sequence: Synthetic polypeptide
DEEEIRTTNPVAYEQYGQCVCGNWGEHNAENFNSDNQA

SEQ ID NO: 199494 - protein, 38 aa, Artificial Sequence
  Description of Artificial Sequence: Synthetic polypeptide
DTEEIRTTNPVATEQYGVVVVTVVTTNNDEEETTEDED

SEQ ID NO: 199495 - protein, 38 aa, Artificial Sequence
  Description of Artificial Sequence: Synthetic polypeptide
DEEEIRTTNPVAYEQYGQCVCGNWGEHNAENFNSDNQS

SEQ ID NO: 199496 - protein, 38 aa, Artificial Sequence
  Description of Artificial Sequence: Synthetic polypeptide
DEAEIACTNPVATEQYGSACAATNPAEEAGRHGDEDAA

SEQ ID NO: 199497 - protein, 38 aa, Artificial Sequence
  Description of Artificial Sequence: Synthetic polypeptide
DEAEIACTNPVATEQYGSACAATNPAEEAGTHGDNDAP

SEQ ID NO: 199498 - protein, 39 aa, Artificial Sequence
  Description of Artificial Sequence: Synthetic polypeptide
DTEEIRTTNPVATEQYGVVVVTVVTTNNDENENGTEDED

SEQ ID NO: 199499 - protein, 38 aa, Artificial Sequence
  Description of Artificial Sequence: Synthetic polypeptide
DEAEIACTNPVATEQYGSACGPTPDGLPLGAMEGFNNQ

SEQ ID NO: 199500 - protein, 38 aa, Artificial Sequence
  Description of Artificial Sequence: Synthetic polypeptide
DEAEIRTTNPVATEQWGICVCSNSGEDNAEASNSDTAS

SEQ ID NO: 199501 - protein, 35 aa, Artificial Sequence
  Description of Artificial Sequence: Synthetic polypeptide
DAEEIATTNPVAYEQWGHSACAAANGDAMQGDQEW

SEQ ID NO: 199502 - protein, 36 aa, Artificial Sequence
  Description of Artificial Sequence: Synthetic polypeptide
CETEIACTNPVATEQWGNVAASGDTPNDAPGGQAYW

SEQ ID NO: 199503 - protein, 34 aa, Artificial Sequence
  Description of Artificial Sequence: Synthetic polypeptide
DENEIATTNPIATECWGATTWANAEDLAEPKGPI

SEQ ID NO: 199504 - protein, 36 aa, Artificial Sequence
  Description of Artificial Sequence: Synthetic polypeptide
DEESIACTNPVAYEQYGSCAAATGNHGNAEGVGMLN

SEQ ID NO: 199505 - protein, 39 aa, Artificial Sequence
  Description of Artificial Sequence: Synthetic polypeptide
DEEEIRTTNPVAYEQYGSTVCAVIEAGGAQASGGDLMAM

SEQ ID NO: 199506 - protein, 36 aa, Artificial Sequence
  Description of Artificial Sequence: Synthetic polypeptide
DEESIACTNPVAYEQYGSCAAAGGNHGNAEGNGENS

SEQ ID NO: 199507 - protein, 37 aa, Artificial Sequence
  Description of Artificial Sequence: Synthetic polypeptide
AEMEIGTTNPVATEQYGCVCSNWGEPNAEFFNSDTQA

SEQ ID NO: 199508 - protein, 38 aa, Artificial Sequence
  Description of Artificial Sequence: Synthetic polypeptide
DENAIRTTNPVATEQYGQCVCSNWEEHNAENFNSDTQS

SEQ ID NO: 199509 - protein, 38 aa, Artificial Sequence
  Description of Artificial Sequence: Synthetic polypeptide
DEEEIACTNPVATEQYGSVANPGGPGGPADAGIGNALD

SEQ ID NO: 199510 - protein, 36 aa, Artificial Sequence
  Description of Artificial Sequence: Synthetic polypeptide
CESEIATTNPCAWEEYGCVCSATGEEWSENMNVGND

SEQ ID NO: 199511 - protein, 38 aa, Artificial Sequence
  Description of Artificial Sequence: Synthetic polypeptide
NEEEIRTTNPVATEQYGYVCVHPSPVNMSNAPDMFFEI

SEQ ID NO: 199512 - protein, 40 aa, Artificial Sequence
  Description of Artificial Sequence: Synthetic polypeptide
DEEEIRTTNPVATEAYGTVVTNGNGNVEIGTTSISTTGNT

SEQ ID NO: 199513 - protein, 39 aa, Artificial Sequence
  Description of Artificial Sequence: Synthetic polypeptide
DEEEIRTTNPVAYEQYGQCVCENWGEDHNQENFNSDFQS

SEQ ID NO: 199514 - protein, 38 aa, Artificial Sequence
  Description of Artificial Sequence: Synthetic polypeptide
SEEEIRCTNPCATEGYGCVCSTWGEDDNAENFGSDNQS

SEQ ID NO: 199515 - protein, 39 aa, Artificial Sequence
  Description of Artificial Sequence: Synthetic polypeptide
DEEEIRTTNPVAYEQYGQCVCSMWGEDHNQEYFGSETQA

SEQ ID NO: 199516 - protein, 36 aa, Artificial Sequence
  Description of Artificial Sequence: Synthetic polypeptide
SEEEIRCTNPCATEGYGCVCSMWGEDNANFGSDTQS

SEQ ID NO: 199517 - protein, 36 aa, Artificial Sequence
  Description of Artificial Sequence: Synthetic polypeptide
DEESIACTNPVAYEQYGSACSANPNANGAHIDEDAH

SEQ ID NO: 199518 - protein, 36 aa, Artificial Sequence
  Description of Artificial Sequence: Synthetic polypeptide
SEEEIRCTNPCATEEYGCVCSNWMEHNAENFGSDQS

SEQ ID NO: 199519 - protein, 39 aa, Artificial Sequence
  Description of Artificial Sequence: Synthetic polypeptide
NEEEIRTTNPVATEQYGYSGDSSMVNTAYENENTEETDT

SEQ ID NO: 199520 - protein, 37 aa, Artificial Sequence
  Description of Artificial Sequence: Synthetic polypeptide
CESEIATTNPCATERYGTVCSATGEEWSENMNGGNDI

SEQ ID NO: 199521 - protein, 36 aa, Artificial Sequence
  Description of Artificial Sequence: Synthetic polypeptide
CDAEIRTTNPVATEQYGCVCSNWGEHDAENFNSDQS

SEQ ID NO: 199522 - protein, 39 aa, Artificial Sequence
  Description of Artificial Sequence: Synthetic polypeptide
DEEEIRTTNPVAYEQYGQCVCSNSGEDHNQENFNSQTQA

SEQ ID NO: 199523 - protein, 35 aa, Artificial Sequence
  Description of Artificial Sequence: Synthetic polypeptide
VEDEIACTNPVATEQWGGCVAATAGGAGMPPYNTH

SEQ ID NO: 199524 - protein, 39 aa, Artificial Sequence
  Description of Artificial Sequence: Synthetic polypeptide
DEEEIRTTNPVAYEQYGSTVCAVGEAGGATAHGGDNEAM

SEQ ID NO: 199525 - protein, 39 aa, Artificial Sequence
  Description of Artificial Sequence: Synthetic polypeptide
DEEEIACTNPVATEQYGSCVAAIGTGDLPATDDMDGEWP

SEQ ID NO: 199526 - protein, 33 aa, Artificial Sequence
  Description of Artificial Sequence: Synthetic polypeptide
VEDEIACTNPVATAQWGCTAGNGLDNHTTDNSM

SEQ ID NO: 199527 - protein, 38 aa, Artificial Sequence
  Description of Artificial Sequence: Synthetic polypeptide
CEEEIACTNPVATEQYGVSTACAANDGEAETEHGNDNQ

SEQ ID NO: 199528 - protein, 36 aa, Artificial Sequence
  Description of Artificial Sequence: Synthetic polypeptide
SEEEIRCTNPCAYEQYGCVCSWGEHNAENFNSDNQS

SEQ ID NO: 199529 - protein, 36 aa, Artificial Sequence
  Description of Artificial Sequence: Synthetic polypeptide
SEEEIRCTNPCAYEQYGCVCSWGEDNAEHFNSDTQA

SEQ ID NO: 199530 - protein, 37 aa, Artificial Sequence
  Description of Artificial Sequence: Synthetic polypeptide
DEQEIATTNPVATEQWGCTTAGNNNEIADMQGDGTNP

SEQ ID NO: 199531 - protein, 34 aa, Artificial Sequence
  Description of Artificial Sequence: Synthetic polypeptide
VEDEIACTNPVATAQWGGCSAATANGMMHPGGTH

SEQ ID NO: 199532 - protein, 37 aa, Artificial Sequence
  Description of Artificial Sequence: Synthetic polypeptide
DENAIRTTNPVATEIYGCVCSNWGEHNAENFNSDNQA

SEQ ID NO: 199533 - protein, 35 aa, Artificial Sequence
  Description of Artificial Sequence: Synthetic polypeptide
DEDEIATTNPVATEQWGTNCAANDGGVEDESNNDM

SEQ ID NO: 199534 - protein, 37 aa, Artificial Sequence
  Description of Artificial Sequence: Synthetic polypeptide
DEEEIACTNPVATEQYGSTACAANPAEGQDHQDDSAG

SEQ ID NO: 199535 - protein, 36 aa, Artificial Sequence
  Description of Artificial Sequence: Synthetic polypeptide
VEDEIACTNPVATAQWGSVSATGAGGQAPQDEANFM

SEQ ID NO: 199536 - protein, 35 aa, Artificial Sequence
  Description of Artificial Sequence: Synthetic polypeptide
DEDEIATTNPVAYESWGCVCTIDSNDRNDQNNKEE

SEQ ID NO: 199537 - protein, 36 aa, Artificial Sequence
  Description of Artificial Sequence: Synthetic polypeptide
CAEEIATTNPVAYEQWGSICTANPAQQEHQDGTEMK

SEQ ID NO: 199538 - protein, 34 aa, Artificial Sequence
  Description of Artificial Sequence: Synthetic polypeptide
DDSEVASTNPVSTEGYGNVWANPTYQSDVGQTRI

SEQ ID NO: 199539 - protein, 40 aa, Artificial Sequence
  Description of Artificial Sequence: Synthetic polypeptide
DTEEIRTTNPVATEAYGVVSVVVVTTNQQLAGTEEGSTDE

SEQ ID NO: 199540 - protein, 33 aa, Artificial Sequence
  Description of Artificial Sequence: Synthetic polypeptide
DENEIATTNPCIYEPYGTTSAMEWDQQQQNNNH

SEQ ID NO: 199541 - protein, 36 aa, Artificial Sequence
  Description of Artificial Sequence: Synthetic polypeptide
CEDEIATTNPVAYEQWGSVCSANPALNEHMIDLTAM

SEQ ID NO: 199542 - protein, 38 aa, Artificial Sequence
  Description of Artificial Sequence: Synthetic polypeptide
DEECIRTTNPVATEGYSACVCSNWGEHNAENFGSDNQA

SEQ ID NO: 199543 - protein, 37 aa, Artificial Sequence
  Description of Artificial Sequence: Synthetic polypeptide
AEECIRTTNPVAYEQYGQCVCSNWGEHNQEYFGSDQA

SEQ ID NO: 199544 - protein, 36 aa, Artificial Sequence
  Description of Artificial Sequence: Synthetic polypeptide
DEDEIATTNPVAYESWGTVCPNDNHDQPGQQGNTEH

SEQ ID NO: 199545 - protein, 37 aa, Artificial Sequence
  Description of Artificial Sequence: Synthetic polypeptide
AEMEISTTNPVATEQYGQCVCSWGEHNEENFNSDTQA

SEQ ID NO: 199546 - protein, 35 aa, Artificial Sequence
  Description of Artificial Sequence: Synthetic polypeptide
CAEEIATTNPVATEQYGCVAPGEGGHGQESEEEQH

SEQ ID NO: 199547 - protein, 35 aa, Artificial Sequence
  Description of Artificial Sequence: Synthetic polypeptide
CEEEIATTNPVATASWGTNCSAAANHGARDSNGSW

SEQ ID NO: 199548 - protein, 38 aa, Artificial Sequence
  Description of Artificial Sequence: Synthetic polypeptide
DEEEIGTTNPVSTEQYGQCVCGNWGEDNQEGFISQTQS

SEQ ID NO: 199549 - protein, 38 aa, Artificial Sequence
  Description of Artificial Sequence: Synthetic polypeptide
CEEEIATTNPVATASWGSVSSTGEHGGINPRDGMEKVN

SEQ ID NO: 199550 - protein, 37 aa, Artificial Sequence
  Description of Artificial Sequence: Synthetic polypeptide
CEEEIATTNPVATASWGSVSSTGEAGINPRDGMEAGN

SEQ ID NO: 199551 - protein, 38 aa, Artificial Sequence
  Description of Artificial Sequence: Synthetic polypeptide
DEAEISTTNPVATEQYGQCVCSWGEDHNQENFGSDTQE

SEQ ID NO: 199552 - protein, 36 aa, Artificial Sequence
  Description of Artificial Sequence: Synthetic polypeptide
VEDEIACTNPVATEQYGSACAAANGQEVNDDLMGDD

SEQ ID NO: 199553 - protein, 37 aa, Artificial Sequence
  Description of Artificial Sequence: Synthetic polypeptide
CEEEIATTNPVATASWGSVSSTGEAGINPDDGMEKVY

SEQ ID NO: 199554 - protein, 38 aa, Artificial Sequence
  Description of Artificial Sequence: Synthetic polypeptide
DEQEIATTNPVATEQWGCNVAGNNGGLPEENNHGADNQ

SEQ ID NO: 199555 - protein, 35 aa, Artificial Sequence
  Description of Artificial Sequence: Synthetic polypeptide
DEMEIGTTNPVATEQYGCLCTATDGPVEAFETDKQ

SEQ ID NO: 199556 - protein, 39 aa, Artificial Sequence
  Description of Artificial Sequence: Synthetic polypeptide
YEEEIRCTNPVATEAYGVVVPDTNFLNRNEGIPGEDTGD

SEQ ID NO: 199557 - protein, 38 aa, Artificial Sequence
  Description of Artificial Sequence: Synthetic polypeptide
CEEEIACTNPVATESYGSACASTNPDEEAGAHQDGGAP

SEQ ID NO: 199558 - protein, 38 aa, Artificial Sequence
  Description of Artificial Sequence: Synthetic polypeptide
DEECIRTTNPVATEGYGQCVCGNWGEDNQENFNSDTQS

SEQ ID NO: 199559 - protein, 34 aa, Artificial Sequence
  Description of Artificial Sequence: Synthetic polypeptide
DDSEVASTNPVSTEGYGNVAANVTPYQSDVGSQR

SEQ ID NO: 199560 - protein, 36 aa, Artificial Sequence
  Description of Artificial Sequence: Synthetic polypeptide
CEDEIATTNPVAYEQYGSCASAGPALGINHMGMQMN

SEQ ID NO: 199561 - protein, 36 aa, Artificial Sequence
  Description of Artificial Sequence: Synthetic polypeptide
CEEEIATTNPVATASWGSVSATGAGGTAPQDIASFQ

SEQ ID NO: 199562 - protein, 35 aa, Artificial Sequence
  Description of Artificial Sequence: Synthetic polypeptide
AEDEIACTNPVAYEQWGEFYSIENDNQRPTPGESM

SEQ ID NO: 199563 - protein, 37 aa, Artificial Sequence
  Description of Artificial Sequence: Synthetic polypeptide
SEEEIRCTNPEATEQYGCVCSWGEDHNAENFGSDTQS

SEQ ID NO: 199564 - protein, 36 aa, Artificial Sequence
  Description of Artificial Sequence: Synthetic polypeptide
DAEEIATTNPVAYEQWGCNTAGNGLVTTAEGGNEDT

SEQ ID NO: 199565 - protein, 38 aa, Artificial Sequence
  Description of Artificial Sequence: Synthetic polypeptide
CAEEIATTNPVAYEQWGSPVCSMANPQPQEHQDGTNMK

SEQ ID NO: 199566 - protein, 36 aa, Artificial Sequence
  Description of Artificial Sequence: Synthetic polypeptide
CAEEIATTNPVAYEQWGSVCSAGPAQQEHQDGTEMK

SEQ ID NO: 199567 - protein, 35 aa, Artificial Sequence
  Description of Artificial Sequence: Synthetic polypeptide
DENEIATTNPVATAQWGCVAGNGEIMNAALMDNHM

SEQ ID NO: 199568 - protein, 37 aa, Artificial Sequence
  Description of Artificial Sequence: Synthetic polypeptide
DEMCIATTNPVATEQYGCVCSNWMEHNEEHFISENQA

SEQ ID NO: 199569 - protein, 36 aa, Artificial Sequence
  Description of Artificial Sequence: Synthetic polypeptide
AEAEIACTNPVATEQYGCSCSWGEPNQEYFGSDTQA

SEQ ID NO: 199570 - protein, 36 aa, Artificial Sequence
  Description of Artificial Sequence: Synthetic polypeptide
AEAEIACTNPVATEQYGCSCSWGEHNQENFGSQTQS

SEQ ID NO: 199571 - protein, 37 aa, Artificial Sequence
  Description of Artificial Sequence: Synthetic polypeptide
SEEEIRCTNPCATEQYGQCVCSWGEDNAEHFNSDTQS

SEQ ID NO: 199572 - protein, 37 aa, Artificial Sequence
  Description of Artificial Sequence: Synthetic polypeptide
VEDEIACTNPVATEQWGCVATNAANPPQANGHGMNNL

SEQ ID NO: 199573 - protein, 37 aa, Artificial Sequence
  Description of Artificial Sequence: Synthetic polypeptide
SEEEIRCTNPCATEQYGQCVCSWEEHNAENFGSDTQS

SEQ ID NO: 199574 - protein, 34 aa, Artificial Sequence
  Description of Artificial Sequence: Synthetic polypeptide
SDNEIATTNPVATEGYGCVCSWEDNQHFISETQA

SEQ ID NO: 199575 - protein, 35 aa, Artificial Sequence
  Description of Artificial Sequence: Synthetic polypeptide
DENEIATTNPVATAQWGCVAGEGGEEMNAALDNAD

SEQ ID NO: 199576 - protein, 35 aa, Artificial Sequence
  Description of Artificial Sequence: Synthetic polypeptide
DENEIATTNPVATAQWGCVAGEGEIMNNALMDNQM

SEQ ID NO: 199577 - protein, 35 aa, Artificial Sequence
  Description of Artificial Sequence: Synthetic polypeptide
DENEIATTNPVATAQWGCVAGEGEIANAALMDNGM

SEQ ID NO: 199578 - protein, 37 aa, Artificial Sequence
  Description of Artificial Sequence: Synthetic polypeptide
DEESIACTNPVATEQYGSACAATNNSENPDDQMEDDA

SEQ ID NO: 199579 - protein, 37 aa, Artificial Sequence
  Description of Artificial Sequence: Synthetic polypeptide
DEESIACTNPVATEQYGSACAPANNTHPGEAGAEMNW

SEQ ID NO: 199580 - protein, 34 aa, Artificial Sequence
  Description of Artificial Sequence: Synthetic polypeptide
AEAEIACTNPCSYEQYGCVCSWNLNAESFGSEQA

SEQ ID NO: 199581 - protein, 35 aa, Artificial Sequence
  Description of Artificial Sequence: Synthetic polypeptide
VEDEIACTNPVATEQWGGCTANNNLENGMLQENDF

SEQ ID NO: 199582 - protein, 38 aa, Artificial Sequence
  Description of Artificial Sequence: Synthetic polypeptide
DEESIACTNPVATEQYGSACSPANEGHPGEAGAEMGNY

SEQ ID NO: 199583 - protein, 38 aa, Artificial Sequence
  Description of Artificial Sequence: Synthetic polypeptide
DEESIACTNPVATEQYGSCASAVGNDITNPDDEMGDEA

SEQ ID NO: 199584 - protein, 39 aa, Artificial Sequence
  Description of Artificial Sequence: Synthetic polypeptide
YEEEIVTTNPVATEFYGVVVPDTNFLDRNEGIPGEDPGD

SEQ ID NO: 199585 - protein, 37 aa, Artificial Sequence
  Description of Artificial Sequence: Synthetic polypeptide
CESEIATTNPCAWEQYGTVCSATGEEWSENMNVGNLD

SEQ ID NO: 199586 - protein, 39 aa, Artificial Sequence
  Description of Artificial Sequence: Synthetic polypeptide
DTEEIRTTNPVATEQYGQSGCWPETDIILIQEYPQEDHQ

SEQ ID NO: 199587 - protein, 36 aa, Artificial Sequence
  Description of Artificial Sequence: Synthetic polypeptide
DEESIACTNPVATEQYGSACAANPAEGQDHQDISAE

SEQ ID NO: 199588 - protein, 37 aa, Artificial Sequence
  Description of Artificial Sequence: Synthetic polypeptide
AEMEISTTNPVATEQYGQCICSWGETNAENFGSDTQS

SEQ ID NO: 199589 - protein, 37 aa, Artificial Sequence
  Description of Artificial Sequence: Synthetic polypeptide
CAEEIATTNPVAYEQWGSVCSANPDNPQEHQDGTEMK

SEQ ID NO: 199590 - protein, 37 aa, Artificial Sequence
  Description of Artificial Sequence: Synthetic polypeptide
CAEEIATTNPVAYEQWGSVCSMANPQPQEHQDGDGMK

SEQ ID NO: 199591 - protein, 36 aa, Artificial Sequence
  Description of Artificial Sequence: Synthetic polypeptide
CAEEIATTNPVAYEQYGSCAQGPALGPNHQMGMQMN

SEQ ID NO: 199592 - protein, 36 aa, Artificial Sequence
  Description of Artificial Sequence: Synthetic polypeptide
CAEEIATTNPVAYEQYGSVCAGNGGDEATAGEGEDD

SEQ ID NO: 199593 - protein, 36 aa, Artificial Sequence
  Description of Artificial Sequence: Synthetic polypeptide
DEESIACTNPVATEQWGSVCAAIEHLDAGTPQDEDA

SEQ ID NO: 199594 - protein, 34 aa, Artificial Sequence
  Description of Artificial Sequence: Synthetic polypeptide
DENEIATTNPVATAQWGTNCAATDGHPVETEIND

SEQ ID NO: 199595 - protein, 35 aa, Artificial Sequence
  Description of Artificial Sequence: Synthetic polypeptide
DENEIATTNPVATAQWGTNCAATDGHPMEGFEIND

SEQ ID NO: 199596 - protein, 36 aa, Artificial Sequence
  Description of Artificial Sequence: Synthetic polypeptide
DEMCIGTTNPVATEQWGCVCSWEEDHNQYFGSDTQA

SEQ ID NO: 199597 - protein, 38 aa, Artificial Sequence
  Description of Artificial Sequence: Synthetic polypeptide
DEQEIRTTNPVATEQYGSHCIHCPWEHDEQPEYENDQG

SEQ ID NO: 199598 - protein, 36 aa, Artificial Sequence
  Description of Artificial Sequence: Synthetic polypeptide
AEAEIACTNPVATEQYGCSCSWMEHNAEYFNSDTQS

SEQ ID NO: 199599 - protein, 37 aa, Artificial Sequence
  Description of Artificial Sequence: Synthetic polypeptide
DEQEIRTTNPVATEQYGSHCIHPWEADEQPEVEIDQG

SEQ ID NO: 199600 - protein, 37 aa, Artificial Sequence
  Description of Artificial Sequence: Synthetic polypeptide
CEDEIATTNPVAYEQWGSVCSANPALAQEHMIDLKAM

SEQ ID NO: 199601 - protein, 38 aa, Artificial Sequence
  Description of Artificial Sequence: Synthetic polypeptide
FEDEIRTTNCVATEQYGSVVNLGGSGELGEEEGGQEDT

SEQ ID NO: 199602 - protein, 37 aa, Artificial Sequence
  Description of Artificial Sequence: Synthetic polypeptide
DEQEIRTTNPVATEQYGSHCIHPWEHDETPEVENDMG

SEQ ID NO: 199603 - protein, 37 aa, Artificial Sequence
  Description of Artificial Sequence: Synthetic polypeptide
CEEEIACTNPVATEQWGCNVAMTNELTNPDDGMGDDH

SEQ ID NO: 199604 - protein, 33 aa, Artificial Sequence
  Description of Artificial Sequence: Synthetic polypeptide
DENEIATTNPCLYEPWGTISAMEWDQQQNNGNH

SEQ ID NO: 199605 - protein, 38 aa, Artificial Sequence
  Description of Artificial Sequence: Synthetic polypeptide
DDECIRTTNPVATEQYGCVCSNWEEDHNAENFNSDNQS

SEQ ID NO: 199606 - protein, 38 aa, Artificial Sequence
  Description of Artificial Sequence: Synthetic polypeptide
DEEEISCTNPVATEQYGCVCSNWGEDHNAEFFNSDTQS

SEQ ID NO: 199607 - protein, 39 aa, Artificial Sequence
  Description of Artificial Sequence: Synthetic polypeptide
DEAEISTTNPVATEQYGQCVCSNWGEDHNQENFGSDNQS

SEQ ID NO: 199608 - protein, 34 aa, Artificial Sequence
  Description of Artificial Sequence: Synthetic polypeptide
DEESIACTNPVATASWGCVAGTGELPNPDDSNHM

SEQ ID NO: 199609 - protein, 38 aa, Artificial Sequence
  Description of Artificial Sequence: Synthetic polypeptide
DEEEISCTNPVATEQYGQCVCSNWGEHNAENFNSDTQA

SEQ ID NO: 199610 - protein, 34 aa, Artificial Sequence
  Description of Artificial Sequence: Synthetic polypeptide
DESEIATTNPIGTEGWGATTWANATLQEPKGPYI

SEQ ID NO: 199611 - protein, 38 aa, Artificial Sequence
  Description of Artificial Sequence: Synthetic polypeptide
DDEEISTTNPVATEQYGQCVCSNWGEHNQESFGSDTQP

SEQ ID NO: 199612 - protein, 39 aa, Artificial Sequence
  Description of Artificial Sequence: Synthetic polypeptide
DEEEIRTTNPVATEQYGQCVCSMWGEDHNQENFISDTQS

SEQ ID NO: 199613 - protein, 34 aa, Artificial Sequence
  Description of Artificial Sequence: Synthetic polypeptide
DSSEVASTNPVSTEPYGNVACNTEISQSRTGGQI

SEQ ID NO: 199614 - protein, 38 aa, Artificial Sequence
  Description of Artificial Sequence: Synthetic polypeptide
DEEEISCTNPVATEQYGQCVCSNWGEHNAENFNSDNQL

SEQ ID NO: 199615 - protein, 38 aa, Artificial Sequence
  Description of Artificial Sequence: Synthetic polypeptide
DDEEISTTNPVATEQYGQCVCSNWGEHNQEHFGSDTQS

SEQ ID NO: 199616 - protein, 38 aa, Artificial Sequence
  Description of Artificial Sequence: Synthetic polypeptide
DEEEISCTNPVATEQYGQCVCSNWGEHNAENFNSDTQS

SEQ ID NO: 199617 - protein, 36 aa, Artificial Sequence
  Description of Artificial Sequence: Synthetic polypeptide
SDAEIRTTNPVATEQYGCCCSWGEHNQEHFGSDTQA

SEQ ID NO: 199618 - protein, 34 aa, Artificial Sequence
  Description of Artificial Sequence: Synthetic polypeptide
DESEIATTNPIGTEGWGATTWANSTLQEPKGPYI

SEQ ID NO: 199619 - protein, 34 aa, Artificial Sequence
  Description of Artificial Sequence: Synthetic polypeptide
DSSEVASTNPVSYEAYGKVAANTEISQSRVGGQR

SEQ ID NO: 199620 - protein, 34 aa, Artificial Sequence
  Description of Artificial Sequence: Synthetic polypeptide
DSSEVASTNPVSYEAYGNTVACNTEISQSRVGPR

SEQ ID NO: 199621 - protein, 36 aa, Artificial Sequence
  Description of Artificial Sequence: Synthetic polypeptide
DDEAISTTNPVATCQYGCVCSNWGEPNANFGSDTQA

SEQ ID NO: 199622 - protein, 35 aa, Artificial Sequence
  Description of Artificial Sequence: Synthetic polypeptide
DSSEVASTNPVSYEAYGNVAANTFSQSRTGGQNRS

SEQ ID NO: 199623 - protein, 37 aa, Artificial Sequence
  Description of Artificial Sequence: Synthetic polypeptide
NEEEIRTTNPVATEFYGMVSVEGMGDGGQGQEAEVGE

SEQ ID NO: 199624 - protein, 37 aa, Artificial Sequence
  Description of Artificial Sequence: Synthetic polypeptide
NEEEIRTTNPVATEFYGMVSVEGMGDGGQGQEMETGT

SEQ ID NO: 199625 - protein, 39 aa, Artificial Sequence
  Description of Artificial Sequence: Synthetic polypeptide
FEEEIRGTNPVATEQYGVVVLVDLMNEIGQGEGDGNDQT

SEQ ID NO: 199626 - protein, 37 aa, Artificial Sequence
  Description of Artificial Sequence: Synthetic polypeptide
DDEEISTTNPVATEQYGQCVCSNWGEHNQGFFSDTQS

SEQ ID NO: 199627 - protein, 38 aa, Artificial Sequence
  Description of Artificial Sequence: Synthetic polypeptide
DDEEISTTNPVATEQYGQCVCSNWGEHNTENFNSDTQA

SEQ ID NO: 199628 - protein, 35 aa, Artificial Sequence
  Description of Artificial Sequence: Synthetic polypeptide
DSSEVASTNPVSTEGYGNVVPACNTISQSRTGGQR

SEQ ID NO: 199629 - protein, 38 aa, Artificial Sequence
  Description of Artificial Sequence: Synthetic polypeptide
DDEEISTTNPVATEQYGQCVCSTWGEHNQENFISEFQA

SEQ ID NO: 199630 - protein, 32 aa, Artificial Sequence
  Description of Artificial Sequence: Synthetic polypeptide
DESEIATTNPIGTECWGATTWAAEDLAHGPYI

SEQ ID NO: 199631 - protein, 39 aa, Artificial Sequence
  Description of Artificial Sequence: Synthetic polypeptide
DDEEISTTNPVATEQYGQCVCSTWGEDHNEENFGSDTQS

SEQ ID NO: 199632 - protein, 38 aa, Artificial Sequence
  Description of Artificial Sequence: Synthetic polypeptide
NEEEIRCTNPVATEQYGCSCSNWGEDHNAEYFQSDTQS

SEQ ID NO: 199633 - protein, 34 aa, Artificial Sequence
  Description of Artificial Sequence: Synthetic polypeptide
DSSEVACTNPVSTEGYGNVCYNTIDQSRHGMQGK

SEQ ID NO: 199634 - protein, 39 aa, Artificial Sequence
  Description of Artificial Sequence: Synthetic polypeptide
DDEEISTTNPVATEQYGQCVCSTWGEDDNAENFNSDTQS

SEQ ID NO: 199635 - protein, 38 aa, Artificial Sequence
  Description of Artificial Sequence: Synthetic polypeptide
DEEEIATTNPVAYEQYGVSTVCAMIEGLGPPREQPSMV

SEQ ID NO: 199636 - protein, 38 aa, Artificial Sequence
  Description of Artificial Sequence: Synthetic polypeptide
DEEEISCTNPVATEQYGQCVCSWGEDDNDEYFGSDTQS

SEQ ID NO: 199637 - protein, 33 aa, Artificial Sequence
  Description of Artificial Sequence: Synthetic polypeptide
DESEIATTNPIGTECWGATTWANAEDLAHGPYI

SEQ ID NO: 199638 - protein, 38 aa, Artificial Sequence
  Description of Artificial Sequence: Synthetic polypeptide
DEEEIRATNPVATEQWGGCNAINNHDEEAAGMEGNARE

SEQ ID NO: 199639 - protein, 38 aa, Artificial Sequence
  Description of Artificial Sequence: Synthetic polypeptide
DDEEISTTNPVATEQYGQCVCSNWMEHNAENFNSDTQS

SEQ ID NO: 199640 - protein, 38 aa, Artificial Sequence
  Description of Artificial Sequence: Synthetic polypeptide
DEEEIRTTNPVATEGYGICVCSWGEDDNQENFISDTQA

SEQ ID NO: 199641 - protein, 36 aa, Artificial Sequence
  Description of Artificial Sequence: Synthetic polypeptide
AEVEIAATNPVAYEQWGSVCYNINGGDDKQNMERHK

SEQ ID NO: 199642 - protein, 39 aa, Artificial Sequence
  Description of Artificial Sequence: Synthetic polypeptide
DEEEIRTTNPVATEGYGICVCSTWVEDHNTENFISDTQA

SEQ ID NO: 199643 - protein, 38 aa, Artificial Sequence
  Description of Artificial Sequence: Synthetic polypeptide
DEEEISCTNPVATEQYGQCVCSNWGENNAENFNSENQS

SEQ ID NO: 199644 - protein, 37 aa, Artificial Sequence
  Description of Artificial Sequence: Synthetic polypeptide
DDEEISTTNPVATEQYGCVCSNWEEHNIENFISDTQA

SEQ ID NO: 199645 - protein, 36 aa, Artificial Sequence
  Description of Artificial Sequence: Synthetic polypeptide
CEEEIACTNPVATEQWGCITAGKGLVQTAESAGMNW

SEQ ID NO: 199646 - protein, 34 aa, Artificial Sequence
  Description of Artificial Sequence: Synthetic polypeptide
DSSEVASTNPVSYEAYGNVAANTISQSGTGGQNR

SEQ ID NO: 199647 - protein, 38 aa, Artificial Sequence
  Description of Artificial Sequence: Synthetic polypeptide
DDEEISTTNPVATEQYGQCVCSNWGEHNAEYFNSDTQS

SEQ ID NO: 199648 - protein, 38 aa, Artificial Sequence
  Description of Artificial Sequence: Synthetic polypeptide
DEEEISCTNPVATEQYGQCVCSNWGEHNAENFNSDNQI

SEQ ID NO: 199649 - protein, 32 aa, Artificial Sequence
  Description of Artificial Sequence: Synthetic polypeptide
DESEIATTNPIGTEGWGVMWAAETWAPKGDYI

SEQ ID NO: 199650 - protein, 38 aa, Artificial Sequence
  Description of Artificial Sequence: Synthetic polypeptide
DEEEISCTNPVATEQYGQCVCSMWGEDNQEGFISQTQA

SEQ ID NO: 199651 - protein, 39 aa, Artificial Sequence
  Description of Artificial Sequence: Synthetic polypeptide
DDEEISTTNPVATEQYGQCVCSNWGEDTNAEGFNSDTQA

SEQ ID NO: 199652 - protein, 37 aa, Artificial Sequence
  Description of Artificial Sequence: Synthetic polypeptide
DEMEIRTTNPVATEGWGCQVCSWGEHNAEYFGSDTQS

SEQ ID NO: 199653 - protein, 34 aa, Artificial Sequence
  Description of Artificial Sequence: Synthetic polypeptide
DSSEVASTNPVSYEGYGNVACNTEISQSRAGGTR

SEQ ID NO: 199654 - protein, 34 aa, Artificial Sequence
  Description of Artificial Sequence: Synthetic polypeptide
DSSEVASTNPVSYEGYGNVACNTHSQSRTGGQDR

SEQ ID NO: 199655 - protein, 38 aa, Artificial Sequence
  Description of Artificial Sequence: Synthetic polypeptide
NEEEIRTTNPVATEGYGAVIVNNDGMENLTANEGGEDV

SEQ ID NO: 199656 - protein, 34 aa, Artificial Sequence
  Description of Artificial Sequence: Synthetic polypeptide
DSSEVASTNPVSYEGYGNVACNTISQSRAGGQYR

SEQ ID NO: 199657 - protein, 36 aa, Artificial Sequence
  Description of Artificial Sequence: Synthetic polypeptide
SDECIATTNPVATEQWGKVCSTWEDHQQHQHQANKG

SEQ ID NO: 199658 - protein, 36 aa, Artificial Sequence
  Description of Artificial Sequence: Synthetic polypeptide
SDECIATTNPVATEQWGKVCSTWEDHQQHQHQNGTQ

SEQ ID NO: 199659 - protein, 39 aa, Artificial Sequence
  Description of Artificial Sequence: Synthetic polypeptide
QEEEIRATNPVATEGYGVVDVGDGTGNVGQEEGEGNDTI

SEQ ID NO: 199660 - protein, 39 aa, Artificial Sequence
  Description of Artificial Sequence: Synthetic polypeptide
QEEEIRATNPVATEQYGMVSVMDDTNEMTGPEDGDEEGQ

SEQ ID NO: 199661 - protein, 34 aa, Artificial Sequence
  Description of Artificial Sequence: Synthetic polypeptide
DSSEVASTNPVSYEGYGNVPACNTISQSETGQNR

SEQ ID NO: 199662 - protein, 35 aa, Artificial Sequence
  Description of Artificial Sequence: Synthetic polypeptide
DSSEVASTNPVSYEGYGNVPACNTISQSRVGGTNR

SEQ ID NO: 199663 - protein, 37 aa, Artificial Sequence
  Description of Artificial Sequence: Synthetic polypeptide
NEEEIRTTNPVATEGYGMVSVVGMGDGGQGQEQDEGV

SEQ ID NO: 199664 - protein, 39 aa, Artificial Sequence
  Description of Artificial Sequence: Synthetic polypeptide
DEEEIRTTNPVATEAYGTVTTQIGTTEQGSTNDENQDES

SEQ ID NO: 199665 - protein, 38 aa, Artificial Sequence
  Description of Artificial Sequence: Synthetic polypeptide
DDEEISTTNPVATEQYGQCVCSNWGEDHNQNFGSDTQS

SEQ ID NO: 199666 - protein, 38 aa, Artificial Sequence
  Description of Artificial Sequence: Synthetic polypeptide
DEREISTTNPVATEQYGQCVCSNWGEHNQENFNSDNQA

SEQ ID NO: 199667 - protein, 38 aa, Artificial Sequence
  Description of Artificial Sequence: Synthetic polypeptide
DDEEISTTNPVATEQYGQCVCSNWGEHNAENFGSDTQL

SEQ ID NO: 199668 - protein, 38 aa, Artificial Sequence
  Description of Artificial Sequence: Synthetic polypeptide
DTNEIRTTNPVATEQYGTVVIYQTDSELQPPYSLEMIQ

SEQ ID NO: 199669 - protein, 38 aa, Artificial Sequence
  Description of Artificial Sequence: Synthetic polypeptide
DDEEISTTNPVATEQYGQCVCSNWGEHNAENFNSDNQS

SEQ ID NO: 199670 - protein, 38 aa, Artificial Sequence
  Description of Artificial Sequence: Synthetic polypeptide
DDEEISTTNPVATEQYGQCVCSNWGEHNAENFNSQTQS

SEQ ID NO: 199671 - protein, 34 aa, Artificial Sequence
  Description of Artificial Sequence: Synthetic polypeptide
DSSEVASTNPVSYEAYGNVACNTIETSRTGGQNR

SEQ ID NO: 199672 - protein, 36 aa, Artificial Sequence
  Description of Artificial Sequence: Synthetic polypeptide
VEDEIACTNPVAYEQYGSVCSAPNQGEEHQDDIQAM

SEQ ID NO: 199673 - protein, 35 aa, Artificial Sequence
  Description of Artificial Sequence: Synthetic polypeptide
DAEEIATTNPVAYEQWGCNTAGNGDTTAEGGNMDE

SEQ ID NO: 199674 - protein, 38 aa, Artificial Sequence
  Description of Artificial Sequence: Synthetic polypeptide
DEEEISCTNPVATEQYGQCVCSNWGEHNAENFISDNQS

SEQ ID NO: 199675 - protein, 39 aa, Artificial Sequence
  Description of Artificial Sequence: Synthetic polypeptide
DEEEISCTNPVATEQYGQCVCSNWGEDTNAEFFNSETQS

SEQ ID NO: 199676 - protein, 33 aa, Artificial Sequence
  Description of Artificial Sequence: Synthetic polypeptide
DESEIATTNPISTEGWGATTANAETWQSPKGPI

SEQ ID NO: 199677 - protein, 34 aa, Artificial Sequence
  Description of Artificial Sequence: Synthetic polypeptide
DSSEVASTNPVSYEAYGQNVACNTIQSFTGGQNR

SEQ ID NO: 199678 - protein, 38 aa, Artificial Sequence
  Description of Artificial Sequence: Synthetic polypeptide
DEEEISCTNPVATEQYGQCVCSNWGEDNTENFNSETQS

SEQ ID NO: 199679 - protein, 38 aa, Artificial Sequence
  Description of Artificial Sequence: Synthetic polypeptide
DDEEISTTNPVATEQYGQCVCSNWGEHNAEYFNSDTQA

SEQ ID NO: 199680 - protein, 33 aa, Artificial Sequence
  Description of Artificial Sequence: Synthetic polypeptide
DESEIATTNPISTEGWGNTTANAETWQSPKGPI

SEQ ID NO: 199681 - protein, 39 aa, Artificial Sequence
  Description of Artificial Sequence: Synthetic polypeptide
DEEEISCTNPVATEQYGQCVCSNWGEDHNQEGFGSDNQS

SEQ ID NO: 199682 - protein, 33 aa, Artificial Sequence
  Description of Artificial Sequence: Synthetic polypeptide
DESEIATTNPISTEGWGNTTANAETWQSPVGPI

SEQ ID NO: 199683 - protein, 38 aa, Artificial Sequence
  Description of Artificial Sequence: Synthetic polypeptide
DEDEIRGTNPVATEFYGTVVMNNDQIGDQNDIEGLGQP

SEQ ID NO: 199684 - protein, 35 aa, Artificial Sequence
  Description of Artificial Sequence: Synthetic polypeptide
DAEEIATTNPVAYEQWGCNTAGNGGTTAEGGNEDK

SEQ ID NO: 199685 - protein, 34 aa, Artificial Sequence
  Description of Artificial Sequence: Synthetic polypeptide
DSSEVASTNPVSYEGYGKVACNTISQSRVGGQNP

SEQ ID NO: 199686 - protein, 36 aa, Artificial Sequence
  Description of Artificial Sequence: Synthetic polypeptide
SDECIATTNPVATEQWGGVCSTWEDHQQHQHVNESH

SEQ ID NO: 199687 - protein, 38 aa, Artificial Sequence
  Description of Artificial Sequence: Synthetic polypeptide
DDEEISTTNPVATEQYGQCVCSNWGEHNAENSISDNQS

SEQ ID NO: 199688 - protein, 38 aa, Artificial Sequence
  Description of Artificial Sequence: Synthetic polypeptide
DDEEISTTNPVATEQYGQCVCSNWGEHNAENFNSQNQI

SEQ ID NO: 199689 - protein, 33 aa, Artificial Sequence
  Description of Artificial Sequence: Synthetic polypeptide
DESEIATTNPIATEGWGVMWAAETWAEPKGDYI

SEQ ID NO: 199690 - protein, 38 aa, Artificial Sequence
  Description of Artificial Sequence: Synthetic polypeptide
DDEEISTTNPVATEQYGCVCSNWEEDHNQENFGSETQA

SEQ ID NO: 199691 - protein, 37 aa, Artificial Sequence
  Description of Artificial Sequence: Synthetic polypeptide
NNEEIRTTNPVATEQYGSVCFPDMVLVEDDITDFHDF

SEQ ID NO: 199692 - protein, 38 aa, Artificial Sequence
  Description of Artificial Sequence: Synthetic polypeptide
TSEEIATTNPCVATEAYGQWVVFSTSAEPHERAEGNYV

SEQ ID NO: 199693 - protein, 35 aa, Artificial Sequence
  Description of Artificial Sequence: Synthetic polypeptide
AEEEIASVNPVCTEQYGCVCSNWEDHNQSFGSDQA

SEQ ID NO: 199694 - protein, 38 aa, Artificial Sequence
  Description of Artificial Sequence: Synthetic polypeptide
DDEEISTTNPVATEQYGCVCSNSGEDHNQENFGSDTQM

SEQ ID NO: 199695 - protein, 38 aa, Artificial Sequence
  Description of Artificial Sequence: Synthetic polypeptide
DTTAEIATTNPVAYEQYGSACSAANPDIPLDSPEGNDH

SEQ ID NO: 199696 - protein, 39 aa, Artificial Sequence
  Description of Artificial Sequence: Synthetic polypeptide
DEEEIRTTNPVATEQYGQCVCQNWGEDHNAENFNSETQA

SEQ ID NO: 199697 - protein, 37 aa, Artificial Sequence
  Description of Artificial Sequence: Synthetic polypeptide
NEEEISTTNPVATEGYGCSCSNWGEDNAENFQSDTQA

SEQ ID NO: 199698 - protein, 35 aa, Artificial Sequence
  Description of Artificial Sequence: Synthetic polypeptide
AEEEIASVNPVCTEQYGCVCSNSGEHNQSFGSDQS

SEQ ID NO: 199699 - protein, 38 aa, Artificial Sequence
  Description of Artificial Sequence: Synthetic polypeptide
DESEICTTNPVATEQYGDVVIMTQGGPEGMLANDDGIE

SEQ ID NO: 199700 - protein, 37 aa, Artificial Sequence
  Description of Artificial Sequence: Synthetic polypeptide
DSNEIRTTNPVATEQYGSVCSVSWPIYEDMEFVEEAQ

SEQ ID NO: 199701 - protein, 37 aa, Artificial Sequence
  Description of Artificial Sequence: Synthetic polypeptide
CEEEIACTNPVATEPYGSACSAANPAEADAEIGNNHP

SEQ ID NO: 199702 - protein, 38 aa, Artificial Sequence
  Description of Artificial Sequence: Synthetic polypeptide
DEEEIRTTNPVATEFYGMVSVEGMGDGGQGQEADEDGT

SEQ ID NO: 199703 - protein, 35 aa, Artificial Sequence
  Description of Artificial Sequence: Synthetic polypeptide
DTTAEIATTNPVAYEQWGSVAIMHGQDSPNGQFQE

SEQ ID NO: 199704 - protein, 40 aa, Artificial Sequence
  Description of Artificial Sequence: Synthetic polypeptide
CEEEIRTTNCVATEQYGVVSILSIPTGDNDGQGEGGDIGD

SEQ ID NO: 199705 - protein, 39 aa, Artificial Sequence
  Description of Artificial Sequence: Synthetic polypeptide
DEDEIRTTNPCATEAYGVVATTNANALQQGATEEGTVIQ

SEQ ID NO: 199706 - protein, 38 aa, Artificial Sequence
  Description of Artificial Sequence: Synthetic polypeptide
AEEEISTTNPVATEQYGQCVCSNWPEHNAENFNSDTQA

SEQ ID NO: 199707 - protein, 36 aa, Artificial Sequence
  Description of Artificial Sequence: Synthetic polypeptide
QEDEIATTNPVATEQYGVVMAGPGEDGEGGQGENEF

SEQ ID NO: 199708 - protein, 38 aa, Artificial Sequence
  Description of Artificial Sequence: Synthetic polypeptide
DEEEIRATNPVATEQWGGCNAINNHVEEAAGMEMNQRE

SEQ ID NO: 199709 - protein, 39 aa, Artificial Sequence
  Description of Artificial Sequence: Synthetic polypeptide
DEEEIRTTNPVATEQYGQCVCQMWGEDHNEENFNSDTQA

SEQ ID NO: 199710 - protein, 36 aa, Artificial Sequence
  Description of Artificial Sequence: Synthetic polypeptide
VEDEIATTNPVATASWGCVAAANNEVQDRGGENTDM

SEQ ID NO: 199711 - protein, 38 aa, Artificial Sequence
  Description of Artificial Sequence: Synthetic polypeptide
AEECIRTTNPVATEEYGQCSCSNWGEDNAENFGSDNQA

SEQ ID NO: 199712 - protein, 36 aa, Artificial Sequence
  Description of Artificial Sequence: Synthetic polypeptide
CEEEIACTNPVATASWGSVSATGAGGTAPQDIADTR

SEQ ID NO: 199713 - protein, 37 aa, Artificial Sequence
  Description of Artificial Sequence: Synthetic polypeptide
DENEIRTTNPVATEQWGNCLVSEAVEEMNIAEFDEAG

SEQ ID NO: 199714 - protein, 38 aa, Artificial Sequence
  Description of Artificial Sequence: Synthetic polypeptide
DEEEISCTNPVAYEQYGQCVCSNSGEHNAENFGSDNQS

SEQ ID NO: 199715 - protein, 39 aa, Artificial Sequence
  Description of Artificial Sequence: Synthetic polypeptide
DEEEIRTTNPVATEQYGQCVCGNWGEDHNAENFNSDNQD

SEQ ID NO: 199716 - protein, 39 aa, Artificial Sequence
  Description of Artificial Sequence: Synthetic polypeptide
DEEEIRTTNPVATEQYGQCVCGNWGEDHNAENFNSDNQS

SEQ ID NO: 199717 - protein, 37 aa, Artificial Sequence
  Description of Artificial Sequence: Synthetic polypeptide
DEEEISCTNPVAYEQYGCVCSNWGEHNAENFNSETQG

SEQ ID NO: 199718 - protein, 36 aa, Artificial Sequence
  Description of Artificial Sequence: Synthetic polypeptide
CEEEIACTNPVATAQWGHSASLANMGTSAEDGNENQ

SEQ ID NO: 199719 - protein, 39 aa, Artificial Sequence
  Description of Artificial Sequence: Synthetic polypeptide
DEEEIRTTNPVATEQYGQCVCGNWGEDHNAENFNSDTQA

SEQ ID NO: 199720 - protein, 39 aa, Artificial Sequence
  Description of Artificial Sequence: Synthetic polypeptide
DEEEIRTTNPVATEQYGQCVCGNWGEDHNAENFNSDTQD

SEQ ID NO: 199721 - protein, 37 aa, Artificial Sequence
  Description of Artificial Sequence: Synthetic polypeptide
TQGEIRATNPVATEQYGACCVQTSPLGPNYPGTVINM

SEQ ID NO: 199722 - protein, 38 aa, Artificial Sequence
  Description of Artificial Sequence: Synthetic polypeptide
TQGEIRTTNPVATEQYGACCCSTSPLGPNYPGTVINMA

SEQ ID NO: 199723 - protein, 38 aa, Artificial Sequence
  Description of Artificial Sequence: Synthetic polypeptide
DENEIRTTNPVATEQWGMVVDNGEEGEEMNATEGDGEQ

SEQ ID NO: 199724 - protein, 38 aa, Artificial Sequence
  Description of Artificial Sequence: Synthetic polypeptide
DEDEIATTNPVAYEQYGSVPAIANNDADTATPGGSENY

SEQ ID NO: 199725 - protein, 38 aa, Artificial Sequence
  Description of Artificial Sequence: Synthetic polypeptide
DEEEISCTNPVAYEQYGCVCSNWGEDHNQENFGSDNQS

SEQ ID NO: 199726 - protein, 38 aa, Artificial Sequence
  Description of Artificial Sequence: Synthetic polypeptide
DEDEIATTNPVAYEQYGSVPAIANNDLDTATPGGSEYA

SEQ ID NO: 199727 - protein, 38 aa, Artificial Sequence
  Description of Artificial Sequence: Synthetic polypeptide
DEAEIACTNPVATEAYGSVVTANAGAPGAQGSPGGQPE

SEQ ID NO: 199728 - protein, 38 aa, Artificial Sequence
  Description of Artificial Sequence: Synthetic polypeptide
CEEEIACTNPVATAQWGSVCSMANPATPNDHGGGMNHW

SEQ ID NO: 199729 - protein, 37 aa, Artificial Sequence
  Description of Artificial Sequence: Synthetic polypeptide
CEEEIACTNPVATAQWGSVSSTGEGGINPRDGMEKVN

SEQ ID NO: 199730 - protein, 38 aa, Artificial Sequence
  Description of Artificial Sequence: Synthetic polypeptide
CEEEIRTTNCVATEQYGVVVVMGGDMNNEQTGEGQGGI

SEQ ID NO: 199731 - protein, 38 aa, Artificial Sequence
  Description of Artificial Sequence: Synthetic polypeptide
DEREISTTNPVATEQYGQCVCSNWGEHNAESFNSDTQS

SEQ ID NO: 199732 - protein, 38 aa, Artificial Sequence
  Description of Artificial Sequence: Synthetic polypeptide
DEEEIRTTNPVATEFYGNVMDGVGDGDGEDDGENTQPT

SEQ ID NO: 199733 - protein, 38 aa, Artificial Sequence
  Description of Artificial Sequence: Synthetic polypeptide
DEDEIRSTNPVATDQYGVVNDNSIGQNGGQEDNDDTFP

SEQ ID NO: 199734 - protein, 35 aa, Artificial Sequence
  Description of Artificial Sequence: Synthetic polypeptide
CEEEIACTNPVATEQWGCIAGAGGLVQTAENAGMN

SEQ ID NO: 199735 - protein, 36 aa, Artificial Sequence
  Description of Artificial Sequence: Synthetic polypeptide
DSSEIATTNPCATEQYGTVCAATGGEWSEAMNGGND

SEQ ID NO: 199736 - protein, 35 aa, Artificial Sequence
  Description of Artificial Sequence: Synthetic polypeptide
DESEIRTTNPVAYERWGVVYAMAGNAGEDLHNNQQ

SEQ ID NO: 199737 - protein, 36 aa, Artificial Sequence
  Description of Artificial Sequence: Synthetic polypeptide
CEEEIACTNPVATEQWGCIFATNGQNPETLENGEEA

SEQ ID NO: 199738 - protein, 37 aa, Artificial Sequence
  Description of Artificial Sequence: Synthetic polypeptide
DEQEIATTNPAVATLQYWGSIDSATQDLEDHEDFEDL

SEQ ID NO: 199739 - protein, 35 aa, Artificial Sequence
  Description of Artificial Sequence: Synthetic polypeptide
DSSEIATTNPVAYDPDGHTVASCPNNHSIIGGNDR

SEQ ID NO: 199740 - protein, 37 aa, Artificial Sequence
  Description of Artificial Sequence: Synthetic polypeptide
DDEEISTTNPVATEQYGQCVCSWGEHNAENFISDTQS

SEQ ID NO: 199741 - protein, 37 aa, Artificial Sequence
  Description of Artificial Sequence: Synthetic polypeptide
DTNEIRTTNPVATEQYGVVIYQTDSEQAPPYSLESIQ

SEQ ID NO: 199742 - protein, 38 aa, Artificial Sequence
  Description of Artificial Sequence: Synthetic polypeptide
DDEEISTTNPVATEQYGQCVCSWGEDHNQEYFGSEFQS

SEQ ID NO: 199743 - protein, 38 aa, Artificial Sequence
  Description of Artificial Sequence: Synthetic polypeptide
DDEEIRTTNPCATEQYGCVCGNWGEDHNQENFGSDTAS

SEQ ID NO: 199744 - protein, 36 aa, Artificial Sequence
  Description of Artificial Sequence: Synthetic polypeptide
DEMEIRTTNPVATEGWGCVCSWGEDNQEYFISQTQA

SEQ ID NO: 199745 - protein, 37 aa, Artificial Sequence
  Description of Artificial Sequence: Synthetic polypeptide
DTNEIRTTNPVATEQYGTVYIYQTDSEQQPPYSLEPQ

SEQ ID NO: 199746 - protein, 38 aa, Artificial Sequence
  Description of Artificial Sequence: Synthetic polypeptide
DDEEISTTNPVATEQYGQCVCSWGEDDNQENFNSDTQA

SEQ ID NO: 199747 - protein, 38 aa, Artificial Sequence
  Description of Artificial Sequence: Synthetic polypeptide
DDEEISTTNPVATEQYGQCVCSWGEAHNQENFNSDTQA

SEQ ID NO: 199748 - protein, 36 aa, Artificial Sequence
  Description of Artificial Sequence: Synthetic polypeptide
CEEEIACTNPVATEQWGCITAGAGLVQTAENPGMNW

SEQ ID NO: 199749 - protein, 35 aa, Artificial Sequence
  Description of Artificial Sequence: Synthetic polypeptide
CEEEIACTNPVAYEQWGSCSAGPAPGQNHMEMQMN

SEQ ID NO: 199750 - protein, 33 aa, Artificial Sequence
  Description of Artificial Sequence: Synthetic polypeptide
DESEIATTNPIATECWGVMWAAETWAEPKGDYI

SEQ ID NO: 199751 - protein, 33 aa, Artificial Sequence
  Description of Artificial Sequence: Synthetic polypeptide
AEMEIACTNPCSYEQYGCVCSWAHNQSFGSEQS

SEQ ID NO: 199752 - protein, 36 aa, Artificial Sequence
  Description of Artificial Sequence: Synthetic polypeptide
VEDEIATTNPVATASWGCVAAANNEVQDRGGENNHI

SEQ ID NO: 199753 - protein, 38 aa, Artificial Sequence
  Description of Artificial Sequence: Synthetic polypeptide
DTSEIRTTNPVATEQYGQSGCWPETDILIQEYPQEDFQ

SEQ ID NO: 199754 - protein, 36 aa, Artificial Sequence
  Description of Artificial Sequence: Synthetic polypeptide
AEDEIATTNPVATECWGCVCTIDSNNHVGQQGGDDA

SEQ ID NO: 199755 - protein, 35 aa, Artificial Sequence
  Description of Artificial Sequence: Synthetic polypeptide
DTSEVACTNPVSTEGYGNVCYNTIDQSRHGNQGQS

SEQ ID NO: 199756 - protein, 35 aa, Artificial Sequence
  Description of Artificial Sequence: Synthetic polypeptide
DTSEVACTNPVSTEGYGNVCYNTIDQSRHGDQRSE

SEQ ID NO: 199757 - protein, 36 aa, Artificial Sequence
  Description of Artificial Sequence: Synthetic polypeptide
DEDEIATTNPVATEQWGGCVAGNGVEMNAAEMDNSM

SEQ ID NO: 199758 - protein, 35 aa, Artificial Sequence
  Description of Artificial Sequence: Synthetic polypeptide
DENEIATTNPVATEQWGCVAGEGVEMNAAEMDHAM

SEQ ID NO: 199759 - protein, 37 aa, Artificial Sequence
  Description of Artificial Sequence: Synthetic polypeptide
DAEEIATTNPVAYEQYGSACSVAPHLNNEAPGGEAMW

SEQ ID NO: 199760 - protein, 34 aa, Artificial Sequence
  Description of Artificial Sequence: Synthetic polypeptide
AEAEIASTNPVGTEGYGVSCGSELNQHFGSDTQS

SEQ ID NO: 199761 - protein, 37 aa, Artificial Sequence
  Description of Artificial Sequence: Synthetic polypeptide
QEEEIKTTNPVATEQYGMITSNMGMEDLNEEGGGEGD

SEQ ID NO: 199762 - protein, 36 aa, Artificial Sequence
  Description of Artificial Sequence: Synthetic polypeptide
DESEIRTTNPVAYQQYGCVCIWINDDPEERNQHDAM

SEQ ID NO: 199763 - protein, 36 aa, Artificial Sequence
  Description of Artificial Sequence: Synthetic polypeptide
DESEIRTTNPVAYQQYGCVCIWINDDPEDRQHDHAG

SEQ ID NO: 199764 - protein, 37 aa, Artificial Sequence
  Description of Artificial Sequence: Synthetic polypeptide
SCSEIGTTNPVATEQYGASAVVAMTVNFIETGTESQE

SEQ ID NO: 199765 - protein, 35 aa, Artificial Sequence
  Description of Artificial Sequence: Synthetic polypeptide
DTSEVACTNPVSTEGYGNVCYNTDIQSRRGDQDRN

SEQ ID NO: 199766 - protein, 38 aa, Artificial Sequence
  Description of Artificial Sequence: Synthetic polypeptide
DEREISTTNPVATEQYGQCVCSNWGEHNQEYFNSDNQA

SEQ ID NO: 199767 - protein, 39 aa, Artificial Sequence
  Description of Artificial Sequence: Synthetic polypeptide
DEEEIRTTNPVATEQYGQCVCSMSGEDDNAENFISDTQA

SEQ ID NO: 199768 - protein, 36 aa, Artificial Sequence
  Description of Artificial Sequence: Synthetic polypeptide
DEMEIRTTNPVATEGWGCVCSWGEHNAEYFSSDTQA

SEQ ID NO: 199769 - protein, 32 aa, Artificial Sequence
  Description of Artificial Sequence: Synthetic polypeptide
ETDEIATTNPCAYEEWGCVYYIVDEQSGQGNA

SEQ ID NO: 199770 - protein, 34 aa, Artificial Sequence
  Description of Artificial Sequence: Synthetic polypeptide
DSSCVASTNPVSTEAYGNVACNTAISQSRTGGQR

SEQ ID NO: 199771 - protein, 34 aa, Artificial Sequence
  Description of Artificial Sequence: Synthetic polypeptide
AETEIRTTNPIATECWGATAWANAEDWQEPGPYI

SEQ ID NO: 199772 - protein, 35 aa, Artificial Sequence
  Description of Artificial Sequence: Synthetic polypeptide
DENEIATTNPVATEQWGCVAGEGVEMNAAEEDTAQ

SEQ ID NO: 199773 - protein, 36 aa, Artificial Sequence
  Description of Artificial Sequence: Synthetic polypeptide
AESEIRTTNPVATEGWGCVCSWGEENAEYFNSDTQS

SEQ ID NO: 199774 - protein, 38 aa, Artificial Sequence
  Description of Artificial Sequence: Synthetic polypeptide
DEEEISCTNPVATEQYGQCVCGNSGEHNAENFNSDNQS

SEQ ID NO: 199775 - protein, 36 aa, Artificial Sequence
  Description of Artificial Sequence: Synthetic polypeptide
VEDEIACTNPVAYEQYGSVCAAPNLGEEHQGDIEAL

SEQ ID NO: 199776 - protein, 39 aa, Artificial Sequence
  Description of Artificial Sequence: Synthetic polypeptide
NEEEIRTTNPVATEQYGQCVCSNWGEDHNAEFFNSDTQA

SEQ ID NO: 199777 - protein, 34 aa, Artificial Sequence
  Description of Artificial Sequence: Synthetic polypeptide
DEQEIATTNPIATEQWGATTWANADWAEPKGPYI

SEQ ID NO: 199778 - protein, 36 aa, Artificial Sequence
  Description of Artificial Sequence: Synthetic polypeptide
SEEEIGCTNPCATEQYGCVCSNWGEDNAEHFGSDQS

SEQ ID NO: 199779 - protein, 38 aa, Artificial Sequence
  Description of Artificial Sequence: Synthetic polypeptide
QEQEIRTTNPVATESYGSVNNPTTPVGPEMGQGENEEG

SEQ ID NO: 199780 - protein, 37 aa, Artificial Sequence
  Description of Artificial Sequence: Synthetic polypeptide
DDEAISTTNPVATEQYGCVCSNWGEDHNQHFNSDTQA

SEQ ID NO: 199781 - protein, 38 aa, Artificial Sequence
  Description of Artificial Sequence: Synthetic polypeptide
QEEEIRGTNPVATDQYGSVVGMGVAGQGLDQGDDTMND

SEQ ID NO: 199782 - protein, 37 aa, Artificial Sequence
  Description of Artificial Sequence: Synthetic polypeptide
SEEEIGCTNPCATEQYGCVCSWGEDDNAEHFGSDNQS

SEQ ID NO: 199783 - protein, 38 aa, Artificial Sequence
  Description of Artificial Sequence: Synthetic polypeptide
DDEEIRATNPVATEFYGQVNFNMDLQMDQGGGGGEQGD

SEQ ID NO: 199784 - protein, 37 aa, Artificial Sequence
  Description of Artificial Sequence: Synthetic polypeptide
DENEIRTTNPVATEQWGEVVDNEEGEEMNAGEDDGAT

SEQ ID NO: 199785 - protein, 37 aa, Artificial Sequence
  Description of Artificial Sequence: Synthetic polypeptide
DDEAISTTNPVATEQYGCVCSNWGEHNAENFNSDNQI

SEQ ID NO: 199786 - protein, 36 aa, Artificial Sequence
  Description of Artificial Sequence: Synthetic polypeptide
DEAEIRTTNPVAYECWGVVCYTTIDEQDGKGQDGGN

SEQ ID NO: 199787 - protein, 36 aa, Artificial Sequence
  Description of Artificial Sequence: Synthetic polypeptide
DESEIRTTNPVAYEGWGCVCSNWMEENQENFGSDQM

SEQ ID NO: 199788 - protein, 37 aa, Artificial Sequence
  Description of Artificial Sequence: Synthetic polypeptide
DDEEIRTTNPCATEGYGCVCSNWGEDNQENFNSDTQA

SEQ ID NO: 199789 - protein, 37 aa, Artificial Sequence
  Description of Artificial Sequence: Synthetic polypeptide
DEDEIRGTNPVATDAYGVVNDNTIGQNGGQEDNDTDI

SEQ ID NO: 199790 - protein, 35 aa, Artificial Sequence
  Description of Artificial Sequence: Synthetic polypeptide
TTAEIATTNPVAYECWGSVSGGPLNDDRQEQGDTV

SEQ ID NO: 199791 - protein, 35 aa, Artificial Sequence
  Description of Artificial Sequence: Synthetic polypeptide
ETSEIATTNPVAYEQWGCVYNNVVRPEDTQARNNA

SEQ ID NO: 199792 - protein, 37 aa, Artificial Sequence
  Description of Artificial Sequence: Synthetic polypeptide
CEDEIATTNPVAYEQWGSVCATGPALGPNHQMGMQMG

SEQ ID NO: 199793 - protein, 35 aa, Artificial Sequence
  Description of Artificial Sequence: Synthetic polypeptide
AENEIACTNPVATEEYGCSCSWGEDHNQYFGSDQA

SEQ ID NO: 199794 - protein, 37 aa, Artificial Sequence
  Description of Artificial Sequence: Synthetic polypeptide
DEECIATTNPVAYEQYGCVCSNWGEHNQEYFNSDTQS

SEQ ID NO: 199795 - protein, 38 aa, Artificial Sequence
  Description of Artificial Sequence: Synthetic polypeptide
DTAEIRTTNPVATEQYGSLAVTGVIMDAEGMNEGQNND

SEQ ID NO: 199796 - protein, 38 aa, Artificial Sequence
  Description of Artificial Sequence: Synthetic polypeptide
DENEIRTTNPVATEFYGVAVTGQLINMQGGEGEGDGQV

SEQ ID NO: 199797 - protein, 37 aa, Artificial Sequence
  Description of Artificial Sequence: Synthetic polypeptide
DDEEIRTTNPCATEHYGCVCSNWGEHNAEYFNSDNQS

SEQ ID NO: 199798 - protein, 38 aa, Artificial Sequence
  Description of Artificial Sequence: Synthetic polypeptide
NEEEIRTTNPVATEQYGMVSVEMGMGDGGQGQEAEDGE

SEQ ID NO: 199799 - protein, 37 aa, Artificial Sequence
  Description of Artificial Sequence: Synthetic polypeptide
CEEEIACTNPVATEQWGCNVAMSNQLTNPDDGMGDQH

SEQ ID NO: 199800 - protein, 37 aa, Artificial Sequence
  Description of Artificial Sequence: Synthetic polypeptide
DDEEIRTTNPCATEHYGCVCSNWGEDNAENFNSDTQS

SEQ ID NO: 199801 - protein, 38 aa, Artificial Sequence
  Description of Artificial Sequence: Synthetic polypeptide
NEEEIRTTNPVATEQYGMVSVEQGMGDGGQGQEAETGG

SEQ ID NO: 199802 - protein, 38 aa, Artificial Sequence
  Description of Artificial Sequence: Synthetic polypeptide
DENEIRTTNPVATEFYGVVDIMQQDNVGQNEEGGGDEE

SEQ ID NO: 199803 - protein, 34 aa, Artificial Sequence
  Description of Artificial Sequence: Synthetic polypeptide
DEQEIATTNPIATEQWGATTWAAADLAEPKGPYI

SEQ ID NO: 199804 - protein, 38 aa, Artificial Sequence
  Description of Artificial Sequence: Synthetic polypeptide
DEEEISCTNPVATEQYGCVCSNWGEDHNQENFNSDTQA

SEQ ID NO: 199805 - protein, 39 aa, Artificial Sequence
  Description of Artificial Sequence: Synthetic polypeptide
NEEEIRTTNPVATEQYGQCSCSNWGEDHNIEYFQSDTQA

SEQ ID NO: 199806 - protein, 35 aa, Artificial Sequence
  Description of Artificial Sequence: Synthetic polypeptide
AENEIACTNPVATEGYGCSCSNWEHNQEYFGSDQS

SEQ ID NO: 199807 - protein, 37 aa, Artificial Sequence
  Description of Artificial Sequence: Synthetic polypeptide
DENEIRTTNPVATEQWGICVCSSGPENAENFSSDTAS

SEQ ID NO: 199808 - protein, 36 aa, Artificial Sequence
  Description of Artificial Sequence: Synthetic polypeptide
DENEIRTTNPVATEGWGCVCSSGEHNANASISDTAA

SEQ ID NO: 199809 - protein, 37 aa, Artificial Sequence
  Description of Artificial Sequence: Synthetic polypeptide
DENEIRTTNPVATEQWGICVCSNSGEENAEYSISDAS

SEQ ID NO: 199810 - protein, 36 aa, Artificial Sequence
  Description of Artificial Sequence: Synthetic polypeptide
DEESIATTNPVAYECWGSVYNWMNDVKGREGKHHME

SEQ ID NO: 199811 - protein, 36 aa, Artificial Sequence
  Description of Artificial Sequence: Synthetic polypeptide
DENAINTTNPVATEYYCSVMSDSNNPLVEPLIEVTM

SEQ ID NO: 199812 - protein, 33 aa, Artificial Sequence
  Description of Artificial Sequence: Synthetic polypeptide
CENEIATTNPVAYEPYGKVLNIIGHFSQHETEG

SEQ ID NO: 199813 - protein, 37 aa, Artificial Sequence
  Description of Artificial Sequence: Synthetic polypeptide
DESEIRTTNPVAYECWGTVCPTDNHGEVNGQKGDHQK

SEQ ID NO: 199814 - protein, 38 aa, Artificial Sequence
  Description of Artificial Sequence: Synthetic polypeptide
CEEEIRTTNCVATEQYGDVVDLGGVNEGEQEGGGGEAE

SEQ ID NO: 199815 - protein, 32 aa, Artificial Sequence
  Description of Artificial Sequence: Synthetic polypeptide
SEEEIGGTNPCGCMQYGSCCTIEGAARNADAV

SEQ ID NO: 199816 - protein, 33 aa, Artificial Sequence
  Description of Artificial Sequence: Synthetic polypeptide
SEEEIGTTNPCGCMQYGSCCCTIEGAARNDDAV

SEQ ID NO: 199817 - protein, 35 aa, Artificial Sequence
  Description of Artificial Sequence: Synthetic polypeptide
DENAINTTNPVATMYYCAVSDSNNPLVEPLGELTM

SEQ ID NO: 199818 - protein, 38 aa, Artificial Sequence
  Description of Artificial Sequence: Synthetic polypeptide
DEEEISCTNPVATEQYGCVCSNWGEDHNQENFGSETQA

SEQ ID NO: 199819 - protein, 34 aa, Artificial Sequence
  Description of Artificial Sequence: Synthetic polypeptide
DEESIACTNPVATASWGCVAGNGENQPDDSNNMD

SEQ ID NO: 199820 - protein, 40 aa, Artificial Sequence
  Description of Artificial Sequence: Synthetic polypeptide
DEEEIRTTNPVATEAYGTVTTVNGNNDEIGTTSISTTGNT

SEQ ID NO: 199821 - protein, 37 aa, Artificial Sequence
  Description of Artificial Sequence: Synthetic polypeptide
VEDEIACTNPVAYEQWGCVSAATNPLPADAGIGNDHL

SEQ ID NO: 199822 - protein, 38 aa, Artificial Sequence
  Description of Artificial Sequence: Synthetic polypeptide
DEEEISCTNPVATEQYGCVCSNWGEDHNAENFNSDTQS

SEQ ID NO: 199823 - protein, 40 aa, Artificial Sequence
  Description of Artificial Sequence: Synthetic polypeptide
DEEEIRTTNPVATEAYGTVTTVTGNSDEIGTTSISTTTNT

SEQ ID NO: 199824 - protein, 38 aa, Artificial Sequence
  Description of Artificial Sequence: Synthetic polypeptide
DEEEISCTNPVATEQYGCVCSNWGEDHNAENFNSDTQP

SEQ ID NO: 199825 - protein, 38 aa, Artificial Sequence
  Description of Artificial Sequence: Synthetic polypeptide
DEEEISCTNPVATEQYGCVCSNWGEDHNAENFNSDTQL

SEQ ID NO: 199826 - protein, 38 aa, Artificial Sequence
  Description of Artificial Sequence: Synthetic polypeptide
DEECIGTTNPVATEQYGQCVCSWGEDDNAENFISDNQS

SEQ ID NO: 199827 - protein, 38 aa, Artificial Sequence
  Description of Artificial Sequence: Synthetic polypeptide
DEECIGTTNPVATEQYGQCVCSWGEDDNQENFGSDTQS

SEQ ID NO: 199828 - protein, 38 aa, Artificial Sequence
  Description of Artificial Sequence: Synthetic polypeptide
DEEEISCTNPVATEQYGCVCSNWGEDHNAENFNSDTQA

SEQ ID NO: 199829 - protein, 37 aa, Artificial Sequence
  Description of Artificial Sequence: Synthetic polypeptide
DEECINTTNPVAYERYGISVFCEQSIHSDDDLGDNLG

SEQ ID NO: 199830 - protein, 38 aa, Artificial Sequence
  Description of Artificial Sequence: Synthetic polypeptide
DDEEISTTNPVATEQYGCVCSNWEELHNAENFNSDNQS

SEQ ID NO: 199831 - protein, 37 aa, Artificial Sequence
  Description of Artificial Sequence: Synthetic polypeptide
DEAEISTTNPVAYEQYGQCVCSWGEDDNQNFGSETQA

SEQ ID NO: 199832 - protein, 38 aa, Artificial Sequence
  Description of Artificial Sequence: Synthetic polypeptide
DEEEISCTNPVATEQYGCVCSNWGEDHNAEHFNSETQS

SEQ ID NO: 199833 - protein, 36 aa, Artificial Sequence
  Description of Artificial Sequence: Synthetic polypeptide
DEECIRCTNPVATEGYGCVCSNWGEDNQENFISDQS

SEQ ID NO: 199834 - protein, 33 aa, Artificial Sequence
  Description of Artificial Sequence: Synthetic polypeptide
DEESIACTNPVATASWGCFAGTGENGPDDSNMD

SEQ ID NO: 199835 - protein, 36 aa, Artificial Sequence
  Description of Artificial Sequence: Synthetic polypeptide
DDEAISTTNPVATEEYGCVCSNWGEHNEESFNSDQS

SEQ ID NO: 199836 - protein, 38 aa, Artificial Sequence
  Description of Artificial Sequence: Synthetic polypeptide
DEECIRTTNPVATEQYGCVCSNWGEDHNQENFISDTQA

SEQ ID NO: 199837 - protein, 36 aa, Artificial Sequence
  Description of Artificial Sequence: Synthetic polypeptide
SEAEAEIATTNPVAYEPWGAVCIENHMEQNQQGNHM

SEQ ID NO: 199838 - protein, 38 aa, Artificial Sequence
  Description of Artificial Sequence: Synthetic polypeptide
QEQEICTTNPVATECYGSVNNEPNNVNGLGQQEGEGED

SEQ ID NO: 199839 - protein, 37 aa, Artificial Sequence
  Description of Artificial Sequence: Synthetic polypeptide
DTEEIATTNPVAYEQWGCVYNNVGRPEDVQDGNGNAS

SEQ ID NO: 199840 - protein, 37 aa, Artificial Sequence
  Description of Artificial Sequence: Synthetic polypeptide
DTEEIATTNPVAYEQWGCVYNNVVRPEDVQDQRHNVS

SEQ ID NO: 199841 - protein, 37 aa, Artificial Sequence
  Description of Artificial Sequence: Synthetic polypeptide
DTEEIATTNPVAYEQWGCVYTNNVVRPEDVQDQHNAS

SEQ ID NO: 199842 - protein, 37 aa, Artificial Sequence
  Description of Artificial Sequence: Synthetic polypeptide
DDEEIRTTNPCATEEYGCVCGTWGEHNAENFISDNAA

SEQ ID NO: 199843 - protein, 33 aa, Artificial Sequence
  Description of Artificial Sequence: Synthetic polypeptide
SEEEIGTTNPCGCMQYGSCCTIPEDAARNADAV

SEQ ID NO: 199844 - protein, 33 aa, Artificial Sequence
  Description of Artificial Sequence: Synthetic polypeptide
SEEEIGTTNPCGCMQYGSCCTIYEGAARNVDAH

SEQ ID NO: 199845 - protein, 36 aa, Artificial Sequence
  Description of Artificial Sequence: Synthetic polypeptide
TTAEIATTNPVAYERWGSAVCEGNGLNDDRQHQGNH

SEQ ID NO: 199846 - protein, 33 aa, Artificial Sequence
  Description of Artificial Sequence: Synthetic polypeptide
SEEEIGTTNPCGCMQYGSCPCTAEGAARNADAV

SEQ ID NO: 199847 - protein, 38 aa, Artificial Sequence
  Description of Artificial Sequence: Synthetic polypeptide
DDEEIRTTNPAATEQYGSVYGQGQGDDEFGIGGQEETN

SEQ ID NO: 199848 - protein, 34 aa, Artificial Sequence
  Description of Artificial Sequence: Synthetic polypeptide
DEQEIATTNPVATAAWGCVAGEGEEMNAALDNAD

SEQ ID NO: 199849 - protein, 35 aa, Artificial Sequence
  Description of Artificial Sequence: Synthetic polypeptide
DEDEIRGTNCVATEAWGVVSAINGEGGDGEQGEQT

SEQ ID NO: 199850 - protein, 33 aa, Artificial Sequence
  Description of Artificial Sequence: Synthetic polypeptide
SEEEIGTTNPCGCMQYGSCQTIYEGAARNPDAV

SEQ ID NO: 199851 - protein, 40 aa, Artificial Sequence
  Description of Artificial Sequence: Synthetic polypeptide
DEEEIRTTNPVATEAYGTVTTVGNSDEIGTTSISTTGGNT

SEQ ID NO: 199852 - protein, 38 aa, Artificial Sequence
  Description of Artificial Sequence: Synthetic polypeptide
SEEEIGTTNPVATEQYGCVCSNWGEDDNAENFNSDNQS

SEQ ID NO: 199853 - protein, 40 aa, Artificial Sequence
  Description of Artificial Sequence: Synthetic polypeptide
DEEEIRTTNPVATEAYGTVTTVGNSDVEIGTTSISTTGNT

SEQ ID NO: 199854 - protein, 35 aa, Artificial Sequence
  Description of Artificial Sequence: Synthetic polypeptide
DEDEIRGTNCVATEAWGSVSAIQGEGGDGEQEEQN

SEQ ID NO: 199855 - protein, 38 aa, Artificial Sequence
  Description of Artificial Sequence: Synthetic polypeptide
DDEEIRTTNPAATEFYGQVNFNMDLQLQDGGEGGETGT

SEQ ID NO: 199856 - protein, 38 aa, Artificial Sequence
  Description of Artificial Sequence: Synthetic polypeptide
DEEEIGTTNPVAYEQYGCVCSNWGEDHNQENFNSDTQA

SEQ ID NO: 199857 - protein, 35 aa, Artificial Sequence
  Description of Artificial Sequence: Synthetic polypeptide
SEAEIACTNPVATAQWGGCCAGTGMLGQHGADNPH

SEQ ID NO: 199858 - protein, 38 aa, Artificial Sequence
  Description of Artificial Sequence: Synthetic polypeptide
CEEEIATTNPVATEQWGGCICTAAAGNHLDDGMKHQNH

SEQ ID NO: 199859 - protein, 38 aa, Artificial Sequence
  Description of Artificial Sequence: Synthetic polypeptide
CEEEIRTTNCVATEQYGVVSILIPLGDNDDGEGGDTGD

SEQ ID NO: 199860 - protein, 39 aa, Artificial Sequence
  Description of Artificial Sequence: Synthetic polypeptide
NEEEIRTTNPVATEQYGAVIVNNDGNENLTANEGGEDVE

SEQ ID NO: 199861 - protein, 38 aa, Artificial Sequence
  Description of Artificial Sequence: Synthetic polypeptide
DDEEISTTNPVATEQYGQCVCSNWEEPNTENFNSETQS

SEQ ID NO: 199862 - protein, 38 aa, Artificial Sequence
  Description of Artificial Sequence: Synthetic polypeptide
DDEEISTTNPVATEQYGQCVCSNWEEHNQEFFGSDTQA

SEQ ID NO: 199863 - protein, 38 aa, Artificial Sequence
  Description of Artificial Sequence: Synthetic polypeptide
DDEEISTTNPVATEQYGQCVCSNWEEHNAENFNSDTQA

SEQ ID NO: 199864 - protein, 39 aa, Artificial Sequence
  Description of Artificial Sequence: Synthetic polypeptide
DDEEISTTNPVATEQYGQCVCSNWEEDTNIEYFNSDTQS

SEQ ID NO: 199865 - protein, 39 aa, Artificial Sequence
  Description of Artificial Sequence: Synthetic polypeptide
QEEEIRCTNPVATEIYGSVNNSTTPEGGPEMGQGENEEN

SEQ ID NO: 199866 - protein, 35 aa, Artificial Sequence
  Description of Artificial Sequence: Synthetic polypeptide
DEDEIRGTNPVATEFWGNVSAADGEGGDGQGEQGV

SEQ ID NO: 199867 - protein, 37 aa, Artificial Sequence
  Description of Artificial Sequence: Synthetic polypeptide
DEHEIATTNPVATECYGSVAYPGEDQHQGQQGQGEGP

SEQ ID NO: 199868 - protein, 38 aa, Artificial Sequence
  Description of Artificial Sequence: Synthetic polypeptide
DDEEISTTNPVATEQYGQCVCSMWGEHNAEYFNSETQS

SEQ ID NO: 199869 - protein, 36 aa, Artificial Sequence
  Description of Artificial Sequence: Synthetic polypeptide
DENEIATTNPVATEQWGANTAGSGNPANPNPMGAQP

SEQ ID NO: 199870 - protein, 37 aa, Artificial Sequence
  Description of Artificial Sequence: Synthetic polypeptide
DEEEIATTNPVAYEQYGVSTVCAMIEGGGPPDQGPSD

SEQ ID NO: 199871 - protein, 34 aa, Artificial Sequence
  Description of Artificial Sequence: Synthetic polypeptide
DEMEIRTTNPVATECWGATCAAADDWVAPEGPYD

SEQ ID NO: 199872 - protein, 35 aa, Artificial Sequence
  Description of Artificial Sequence: Synthetic polypeptide
DSSEVASTNPVSYEGYGTVVACNTGSQSRVGGQNR

SEQ ID NO: 199873 - protein, 33 aa, Artificial Sequence
  Description of Artificial Sequence: Synthetic polypeptide
DSSEVASTNPVSYEPWGNVACNTISQSRVGGQR

SEQ ID NO: 199874 - protein, 38 aa, Artificial Sequence
  Description of Artificial Sequence: Synthetic polypeptide
AEEEISTTNPVATEQYGQCVCSNWGEHNAENFNSDFQP

SEQ ID NO: 199875 - protein, 38 aa, Artificial Sequence
  Description of Artificial Sequence: Synthetic polypeptide
AEEEISTTNPVATEQYGQCVCSNWGEHNAENFNSDTQM

SEQ ID NO: 199876 - protein, 39 aa, Artificial Sequence
  Description of Artificial Sequence: Synthetic polypeptide
QEEEIRCTNPVATEAYGSVNNVTTPENGPEMGQGENEEG

SEQ ID NO: 199877 - protein, 35 aa, Artificial Sequence
  Description of Artificial Sequence: Synthetic polypeptide
DEQEIATTNPIATECWGSTVWSNAEDWAEPEGPYI

SEQ ID NO: 199878 - protein, 34 aa, Artificial Sequence
  Description of Artificial Sequence: Synthetic polypeptide
DEMEIRTTNPVATECWGATWAAADDWVAPEGPYD

SEQ ID NO: 199879 - protein, 39 aa, Artificial Sequence
  Description of Artificial Sequence: Synthetic polypeptide
DENEIRTTNPVATEGYGSVVYDITQNVNFDDEGGQDQEE

SEQ ID NO: 199880 - protein, 34 aa, Artificial Sequence
  Description of Artificial Sequence: Synthetic polypeptide
DSSEVASTNPVSYEGYGNVVACNTFSQSRTGQNL

SEQ ID NO: 199881 - protein, 37 aa, Artificial Sequence
  Description of Artificial Sequence: Synthetic polypeptide
SDECIATTNPVATEQWGKVCSTWEDHQQHQHVGNEVK

SEQ ID NO: 199882 - protein, 39 aa, Artificial Sequence
  Description of Artificial Sequence: Synthetic polypeptide
DDEEISTTNPVATEQYGQCVCSNWGEDHNAEYFGSENQS

SEQ ID NO: 199883 - protein, 38 aa, Artificial Sequence
  Description of Artificial Sequence: Synthetic polypeptide
AEECIRTTNPVATEQYGCVCSNWGEDHNDENFGSDTQS

SEQ ID NO: 199884 - protein, 38 aa, Artificial Sequence
  Description of Artificial Sequence: Synthetic polypeptide
DEEEIATTNPVAYEQYGVSTVCAMIEGLGPPDQDPSAM

SEQ ID NO: 199885 - protein, 35 aa, Artificial Sequence
  Description of Artificial Sequence: Synthetic polypeptide
SEAEIACTNPVATEQWGAVCAQNPPVNTAGNPEGT

SEQ ID NO: 199886 - protein, 37 aa, Artificial Sequence
  Description of Artificial Sequence: Synthetic polypeptide
DDEEIRTTNPCATEHYGQCVCSWGEPNQENFNSDTQS

SEQ ID NO: 199887 - protein, 38 aa, Artificial Sequence
  Description of Artificial Sequence: Synthetic polypeptide
DEEEIRATNPVATEQWGGCNAINNGGEEAAGMEMNARE

SEQ ID NO: 199888 - protein, 35 aa, Artificial Sequence
  Description of Artificial Sequence: Synthetic polypeptide
DEMEIRTTNPVATECWGTTTWANTDDPAEPKGPYI

SEQ ID NO: 199889 - protein, 38 aa, Artificial Sequence
  Description of Artificial Sequence: Synthetic polypeptide
DESEIRTTNPVAYEQWGTVCPTDNHGEVNGQKGMDGQK

SEQ ID NO: 199890 - protein, 37 aa, Artificial Sequence
  Description of Artificial Sequence: Synthetic polypeptide
DDEEIRTTNPCATEHYGQCVCSWGEDNQENFNSNNQA

SEQ ID NO: 199891 - protein, 35 aa, Artificial Sequence
  Description of Artificial Sequence: Synthetic polypeptide
DSSEVASTNPVSYEGYGNVVACQTISQQRVGGQNR

SEQ ID NO: 199892 - protein, 36 aa, Artificial Sequence
  Description of Artificial Sequence: Synthetic polypeptide
DENEIATTNPVATEQWGCNAGENGVDMNAAEEDNML

SEQ ID NO: 199893 - protein, 34 aa, Artificial Sequence
  Description of Artificial Sequence: Synthetic polypeptide
ETEEIATTNPCAYEEWGCVYYIVDERQRGQGNQA

SEQ ID NO: 199894 - protein, 38 aa, Artificial Sequence
  Description of Artificial Sequence: Synthetic polypeptide
DEEEIRATNPVATEQWGGCHNAITNHDEFAGMENNVNG

SEQ ID NO: 199895 - protein, 38 aa, Artificial Sequence
  Description of Artificial Sequence: Synthetic polypeptide
CEEEIACTNPVATEQYGSACNPTPDGLPLGAGEGENDQ

SEQ ID NO: 199896 - protein, 37 aa, Artificial Sequence
  Description of Artificial Sequence: Synthetic polypeptide
DEDEIATTNPVATEQYGSACAAANPPEVNDDGMGDDH

SEQ ID NO: 199897 - protein, 34 aa, Artificial Sequence
  Description of Artificial Sequence: Synthetic polypeptide
DEHEIASTNPVAYECWGTVYWINENQDRQMIAVG

SEQ ID NO: 199898 - protein, 38 aa, Artificial Sequence
  Description of Artificial Sequence: Synthetic polypeptide
DEREISTTNPVATEQYGQCVCSNWGEHNAENFNSDTQL

SEQ ID NO: 199899 - protein, 38 aa, Artificial Sequence
  Description of Artificial Sequence: Synthetic polypeptide
AEEEISTTNPVATEQYGQCVCSNWGEHNAENFNSETQA

SEQ ID NO: 199900 - protein, 38 aa, Artificial Sequence
  Description of Artificial Sequence: Synthetic polypeptide
AEEEISTTNPVATEQYGQCVCSNWGEHNAEYFNSDTQS

SEQ ID NO: 199901 - protein, 38 aa, Artificial Sequence
  Description of Artificial Sequence: Synthetic polypeptide
DEDEIRGTNPVATDQYGVVVDNSIGQNQGGQEDNDTCT

SEQ ID NO: 199902 - protein, 39 aa, Artificial Sequence
  Description of Artificial Sequence: Synthetic polypeptide
DESEICTTNCVATEQYGSVVLDGMEGLTDGQEGDQNGDM

SEQ ID NO: 199903 - protein, 36 aa, Artificial Sequence
  Description of Artificial Sequence: Synthetic polypeptide
DTETAEIATTNPVAYEPWGVVTISAGMLGNTPDGNN

SEQ ID NO: 199904 - protein, 33 aa, Artificial Sequence
  Description of Artificial Sequence: Synthetic polypeptide
CENEIATTNPVAYEPYGKVFIIGHEPSQHETEG

SEQ ID NO: 199905 - protein, 35 aa, Artificial Sequence
  Description of Artificial Sequence: Synthetic polypeptide
DESEICATNPVAYEQWGMVPGWINDHQHGQGGGDL

SEQ ID NO: 199906 - protein, 37 aa, Artificial Sequence
  Description of Artificial Sequence: Synthetic polypeptide
DENAINTTNPVATEYYCESVSDSNNPLVECPLGEVSM

SEQ ID NO: 199907 - protein, 38 aa, Artificial Sequence
  Description of Artificial Sequence: Synthetic polypeptide
DEDEIRGTNPVATDQYGVVNDNSIGQNQGGQEDNQDTY

SEQ ID NO: 199908 - protein, 38 aa, Artificial Sequence
  Description of Artificial Sequence: Synthetic polypeptide
DEDEIRGTNPVATDQYGVVNDNSIGQNQGGQEDNNDPD

SEQ ID NO: 199909 - protein, 35 aa, Artificial Sequence
  Description of Artificial Sequence: Synthetic polypeptide
SEAEIACTNPVATAQWGGCIAGTGMLGQHGDDNHH

SEQ ID NO: 199910 - protein, 38 aa, Artificial Sequence
  Description of Artificial Sequence: Synthetic polypeptide
DEDEIRGTNPVATDQYGVVNDNSIGQNQGGQEDNDQDI

SEQ ID NO: 199911 - protein, 32 aa, Artificial Sequence
  Description of Artificial Sequence: Synthetic polypeptide
DSTDIACTNPVATAQWGGCVAGTMHDPDSGGN

SEQ ID NO: 199912 - protein, 38 aa, Artificial Sequence
  Description of Artificial Sequence: Synthetic polypeptide
DEDEIRGTNPVATDQYGVVNDNSIGQNQGGQEDNALTC

SEQ ID NO: 199913 - protein, 38 aa, Artificial Sequence
  Description of Artificial Sequence: Synthetic polypeptide
DAEEIATTNPVATEQYGSVCAMANHADDSKAPADSFER

SEQ ID NO: 199914 - protein, 34 aa, Artificial Sequence
  Description of Artificial Sequence: Synthetic polypeptide
AEMEIACTNPCSYEQYGCVCSWNPNQSFGSETQS

SEQ ID NO: 199915 - protein, 38 aa, Artificial Sequence
  Description of Artificial Sequence: Synthetic polypeptide
DEEEIACTNPVATEQYGSACATVNPDEEAGAHLDGAAP

SEQ ID NO: 199916 - protein, 38 aa, Artificial Sequence
  Description of Artificial Sequence: Synthetic polypeptide
DEDEIRGTNPVATDQYGVVNDNSIGQNGGQEDNSDNDG

SEQ ID NO: 199917 - protein, 35 aa, Artificial Sequence
  Description of Artificial Sequence: Synthetic polypeptide
TTAEIASTNPVAYECWGSVCSGGLNDDRQEQGNHG

SEQ ID NO: 199918 - protein, 37 aa, Artificial Sequence
  Description of Artificial Sequence: Synthetic polypeptide
AEECIRTTNPVATEQYSACVCSWGEHNQENFGSDTQA

SEQ ID NO: 199919 - protein, 35 aa, Artificial Sequence
  Description of Artificial Sequence: Synthetic polypeptide
DEQEIATTNPIATECYGATTWANAEDLAEPKGEDI

SEQ ID NO: 199920 - protein, 38 aa, Artificial Sequence
  Description of Artificial Sequence: Synthetic polypeptide
AEECIRTTNPVATEQYGQCVCSMWGEHNEENFNSDTQA

SEQ ID NO: 199921 - protein, 34 aa, Artificial Sequence
  Description of Artificial Sequence: Synthetic polypeptide
DEQEIATTNPIATECYGATWAAAEDLEEPKGEDL

SEQ ID NO: 199922 - protein, 38 aa, Artificial Sequence
  Description of Artificial Sequence: Synthetic polypeptide
AEEEISTTNPVATEQYGQCVCSNWGEHNAEYFNSETQA

SEQ ID NO: 199923 - protein, 34 aa, Artificial Sequence
  Description of Artificial Sequence: Synthetic polypeptide
DSSEVASTNPVSYEPYGNTVACNTISQSRVGGMR

SEQ ID NO: 199924 - protein, 35 aa, Artificial Sequence
  Description of Artificial Sequence: Synthetic polypeptide
DEQEIATTNPIATECYGATTWANAEDLAEPKGEDL

SEQ ID NO: 199925 - protein, 38 aa, Artificial Sequence
  Description of Artificial Sequence: Synthetic polypeptide
AEEEISTTNPVATEQYGQCVCSNWGEHNAEYSNSENQA

SEQ ID NO: 199926 - protein, 34 aa, Artificial Sequence
  Description of Artificial Sequence: Synthetic polypeptide
DEMEIRTTNPVATECWGATCAAADDPVAPEGPYD

SEQ ID NO: 199927 - protein, 38 aa, Artificial Sequence
  Description of Artificial Sequence: Synthetic polypeptide
DESEIRTTNPVAYEQWGSACYTGDRLQNDRNTQKQDDD

SEQ ID NO: 199928 - protein, 35 aa, Artificial Sequence
  Description of Artificial Sequence: Synthetic polypeptide
DENAINTTNPEATEYTCSVSDSNNPLYEPLGELTM

SEQ ID NO: 199929 - protein, 36 aa, Artificial Sequence
  Description of Artificial Sequence: Synthetic polypeptide
CEEEIATTNPVATEQWGGCNCAGTGQLDNIMGGPLH

SEQ ID NO: 199930 - protein, 37 aa, Artificial Sequence
  Description of Artificial Sequence: Synthetic polypeptide
CEEEIACTNPVATEQWGCNCNAASGNLDQTAPDGEGH

SEQ ID NO: 199931 - protein, 36 aa, Artificial Sequence
  Description of Artificial Sequence: Synthetic polypeptide
DENAINTTNPVATEYCCMSVSDSNNPLYEPLGELTM

SEQ ID NO: 199932 - protein, 35 aa, Artificial Sequence
  Description of Artificial Sequence: Synthetic polypeptide
DEQEIATTNPIATECYGATTWANAEDLAEPKGPDI

SEQ ID NO: 199933 - protein, 39 aa, Artificial Sequence
  Description of Artificial Sequence: Synthetic polypeptide
DESEICTTNPCATEQYGSVVQDGMQGLTDGQEGDQNGDM

SEQ ID NO: 199934 - protein, 35 aa, Artificial Sequence
  Description of Artificial Sequence: Synthetic polypeptide
SEAEIACTNPVATAQWGGCVAGQGMLGQHGDDNPH

SEQ ID NO: 199935 - protein, 38 aa, Artificial Sequence
  Description of Artificial Sequence: Synthetic polypeptide
DEREISTTNPVATEQYGQCVCSNWGEDNAENFNSENQS

SEQ ID NO: 199936 - protein, 36 aa, Artificial Sequence
  Description of Artificial Sequence: Synthetic polypeptide
DENAINTTNPVATEYGYCSVSDSNNPLYEPLAELTM

SEQ ID NO: 199937 - protein, 38 aa, Artificial Sequence
  Description of Artificial Sequence: Synthetic polypeptide
AEEEISTTNPVATEQYGQCVCSNWGEHNIEYFNSDTQS

SEQ ID NO: 199938 - protein, 35 aa, Artificial Sequence
  Description of Artificial Sequence: Synthetic polypeptide
DEQEIATTNPIATECYGATTWANAEDLAEPKGPYI

SEQ ID NO: 199939 - protein, 38 aa, Artificial Sequence
  Description of Artificial Sequence: Synthetic polypeptide
DEAEIRTTNPVAYEGYGCVTSTWGADHNAENFGSDTQA

SEQ ID NO: 199940 - protein, 39 aa, Artificial Sequence
  Description of Artificial Sequence: Synthetic polypeptide
VENEIRTTNPVATEFYGEVSTTDGGNNLLSEEDEDNEGA

SEQ ID NO: 199941 - protein, 37 aa, Artificial Sequence
  Description of Artificial Sequence: Synthetic polypeptide
DEEEIACTNPVATEQYGSACAANPAEGQDHQDDQMAK

SEQ ID NO: 199942 - protein, 39 aa, Artificial Sequence
  Description of Artificial Sequence: Synthetic polypeptide
DDEEIKTTNPVATEQYGAVNMTNTTINQEGQEEGGFTGD

SEQ ID NO: 199943 - protein, 38 aa, Artificial Sequence
  Description of Artificial Sequence: Synthetic polypeptide
DEMEISTTNPVATEQYGQCVCSNSGEPNAEFFGSDTQA

SEQ ID NO: 199944 - protein, 33 aa, Artificial Sequence
  Description of Artificial Sequence: Synthetic polypeptide
QECEICATNPCTTEIYGVVATQAGTNQNGTTTE

SEQ ID NO: 199945 - protein, 35 aa, Artificial Sequence
  Description of Artificial Sequence: Synthetic polypeptide
DETEIACTNPVATEQWGTNCPAAAAHGMNRSNDSW

SEQ ID NO: 199946 - protein, 38 aa, Artificial Sequence
  Description of Artificial Sequence: Synthetic polypeptide
DDECIRTTNPVATEQYGQCVCSNWGEHNIEYFNSDTQS

SEQ ID NO: 199947 - protein, 39 aa, Artificial Sequence
  Description of Artificial Sequence: Synthetic polypeptide
SEEEIRTTNPVATEAYGMVDNGQGTNDGQEGGGGEQFGD

SEQ ID NO: 199948 - protein, 40 aa, Artificial Sequence
  Description of Artificial Sequence: Synthetic polypeptide
DEEEIRTTNPVATLQYGTVAARSFELANIIENTSGAQNYF

SEQ ID NO: 199949 - protein, 37 aa, Artificial Sequence
  Description of Artificial Sequence: Synthetic polypeptide
VEDEIATTNPVAYEQYGSVANPYQGLDQGTPQDENND

SEQ ID NO: 199950 - protein, 34 aa, Artificial Sequence
  Description of Artificial Sequence: Synthetic polypeptide
DETEIACTNPVATEQWGTNCAAAAEHGMRSNDSW

SEQ ID NO: 199951 - protein, 37 aa, Artificial Sequence
  Description of Artificial Sequence: Synthetic polypeptide
MEYEISTTNPVATEFYGAVSATGDQGQEDQEGGEDGD

SEQ ID NO: 199952 - protein, 37 aa, Artificial Sequence
  Description of Artificial Sequence: Synthetic polypeptide
DDEEISTTNPVATEEYGCVCSNWGEHNAENFNSDNQA

SEQ ID NO: 199953 - protein, 38 aa, Artificial Sequence
  Description of Artificial Sequence: Synthetic polypeptide
DDECIRTTNPVATEQYGQCVCSNWGEHNAENFGSDTQS

SEQ ID NO: 199954 - protein, 39 aa, Artificial Sequence
  Description of Artificial Sequence: Synthetic polypeptide
DEEEIRTTNPVATEFYGVVVNMMGINNMDNQTGEFTEEG

SEQ ID NO: 199955 - protein, 36 aa, Artificial Sequence
  Description of Artificial Sequence: Synthetic polypeptide
DDAEISTTNPVATEQYGCCCSWGEHNAEHFGSQTQA

SEQ ID NO: 199956 - protein, 38 aa, Artificial Sequence
  Description of Artificial Sequence: Synthetic polypeptide
DQAEIRTTNPVATEQYGCSCSNWGEDHNQENFGSDTQA

SEQ ID NO: 199957 - protein, 39 aa, Artificial Sequence
  Description of Artificial Sequence: Synthetic polypeptide
DDEEIRTTNPVATEFYGCVTVNMTGLQTEDQDEGGETLG

SEQ ID NO: 199958 - protein, 40 aa, Artificial Sequence
  Description of Artificial Sequence: Synthetic polypeptide
DDEEIKTTNPVATEQYGAVNMTNAIIQQEGDQEEGGNQIF

SEQ ID NO: 199959 - protein, 39 aa, Artificial Sequence
  Description of Artificial Sequence: Synthetic polypeptide
DEEEISTTNPVAYEQYGQCVCSNWGEDHNAESFGSENQS

SEQ ID NO: 199960 - protein, 37 aa, Artificial Sequence
  Description of Artificial Sequence: Synthetic polypeptide
DETEIACTNPVATEQYGCSSAANTHGPEAGGNLEETN

SEQ ID NO: 199961 - protein, 38 aa, Artificial Sequence
  Description of Artificial Sequence: Synthetic polypeptide
CEGEIRTTNPVATEGYGSVNNDEFQDEEEDEDGGNQGN

SEQ ID NO: 199962 - protein, 36 aa, Artificial Sequence
  Description of Artificial Sequence: Synthetic polypeptide
DETEIACTNPVATEQYGSACAAAPHLNEAPMEEGKN

SEQ ID NO: 199963 - protein, 39 aa, Artificial Sequence
  Description of Artificial Sequence: Synthetic polypeptide
DDEEIRTTNPVATEFYGQVNFNMDLQGDDQGGGGGEQLD

SEQ ID NO: 199964 - protein, 36 aa, Artificial Sequence
  Description of Artificial Sequence: Synthetic polypeptide
DEMEISTTNPVATEQYGQCVCQWGADNIENFMSDQS

SEQ ID NO: 199965 - protein, 38 aa, Artificial Sequence
  Description of Artificial Sequence: Synthetic polypeptide
METEIRTTNPVATEQYGDVTTVMNNGFEGGDEGGETQY

SEQ ID NO: 199966 - protein, 36 aa, Artificial Sequence
  Description of Artificial Sequence: Synthetic polypeptide
SEEEIATTNPVATEQYGCSCGWEDDNQEHFISETQS

SEQ ID NO: 199967 - protein, 36 aa, Artificial Sequence
  Description of Artificial Sequence: Synthetic polypeptide
SEEEIATTNPVATEQYGCSCGWGEDDNQEHFSSEQA

SEQ ID NO: 199968 - protein, 37 aa, Artificial Sequence
  Description of Artificial Sequence: Synthetic polypeptide
AEEEIATTNPVATEQYGCYCPNWGEDDNQHFNSETQA

SEQ ID NO: 199969 - protein, 37 aa, Artificial Sequence
  Description of Artificial Sequence: Synthetic polypeptide
SEEEIATTNPVATEQYGCSCPNWEDDNQEHFSSENQA

SEQ ID NO: 199970 - protein, 33 aa, Artificial Sequence
  Description of Artificial Sequence: Synthetic polypeptide
AEHEIASTNPVGYEAYGVVMAYSGLSQHPVGDQ

SEQ ID NO: 199971 - protein, 39 aa, Artificial Sequence
  Description of Artificial Sequence: Synthetic polypeptide
DENEISTTNPVATEQYGQCVCSTWGEDHNAESFNSDTQS

SEQ ID NO: 199972 - protein, 38 aa, Artificial Sequence
  Description of Artificial Sequence: Synthetic polypeptide
DEMEISTTNPVATEQYGQCVCSNSGEHNAENFNSDTQS

SEQ ID NO: 199973 - protein, 33 aa, Artificial Sequence
  Description of Artificial Sequence: Synthetic polypeptide
AEHEIASTNPVGYEAYGVVMAYSGQSNHTVGDI

SEQ ID NO: 199974 - protein, 32 aa, Artificial Sequence
  Description of Artificial Sequence: Synthetic polypeptide
QEYEIACTNPCSYEQWGITCYCNDQQDHNDTR

SEQ ID NO: 199975 - protein, 37 aa, Artificial Sequence
  Description of Artificial Sequence: Synthetic polypeptide
DETEIACTNPVATEQYGCTACAANDGLPLGSEGNEHP

SEQ ID NO: 199976 - protein, 39 aa, Artificial Sequence
  Description of Artificial Sequence: Synthetic polypeptide
DDEEIRTTNPVATEFYGCVTVNMTGLQEDEDEFGGETTT

SEQ ID NO: 199977 - protein, 38 aa, Artificial Sequence
  Description of Artificial Sequence: Synthetic polypeptide
DDEEIRTTNPVATEFYGCVTVNMTGDQEDQDEGGETLI

SEQ ID NO: 199978 - protein, 37 aa, Artificial Sequence
  Description of Artificial Sequence: Synthetic polypeptide
CEEEIACTNPVATEQYGSACSADNPGPAEAPIGDEHQ

SEQ ID NO: 199979 - protein, 37 aa, Artificial Sequence
  Description of Artificial Sequence: Synthetic polypeptide
CEAEIATTNPVAYEQYGSTVAIANNWTIQENGDQTAQ

SEQ ID NO: 199980 - protein, 38 aa, Artificial Sequence
  Description of Artificial Sequence: Synthetic polypeptide
DEEEISTTNPVAYEQYGQCVCSNWGEHNAENFGSDTQA

SEQ ID NO: 199981 - protein, 38 aa, Artificial Sequence
  Description of Artificial Sequence: Synthetic polypeptide
MNGEIRTTNPVATEQYGSCSSPAPAEGPNMVFEGNSDA

SEQ ID NO: 199982 - protein, 38 aa, Artificial Sequence
  Description of Artificial Sequence: Synthetic polypeptide
DEEEISTTNPVAYEQYGQCVCSNWGEHNAENFISDNQS

SEQ ID NO: 199983 - protein, 36 aa, Artificial Sequence
  Description of Artificial Sequence: Synthetic polypeptide
CEAEIATTNPVATEQWGGCCTAAAGNHLDNGMHLHN

SEQ ID NO: 199984 - protein, 39 aa, Artificial Sequence
  Description of Artificial Sequence: Synthetic polypeptide
DDEEIRTTNPVATEFYGCVNVNMTGLQEEENDGFGETPT

SEQ ID NO: 199985 - protein, 37 aa, Artificial Sequence
  Description of Artificial Sequence: Synthetic polypeptide
DETEIACTNPVATEQWGSVAGPAIAPPQAAGNPPEQN

SEQ ID NO: 199986 - protein, 38 aa, Artificial Sequence
  Description of Artificial Sequence: Synthetic polypeptide
DEEEISTTNPVAYEQYGQCVCSNWGEHNAENFMSENQA

SEQ ID NO: 199987 - protein, 38 aa, Artificial Sequence
  Description of Artificial Sequence: Synthetic polypeptide
DEEEISTTNPVAYEQYGQCVCSNWGEHNAENFNSDNQI

SEQ ID NO: 199988 - protein, 38 aa, Artificial Sequence
  Description of Artificial Sequence: Synthetic polypeptide
DEEEISTTNPVAYEQYGQCVCSNWGEHNAENFNSDTQS

SEQ ID NO: 199989 - protein, 36 aa, Artificial Sequence
  Description of Artificial Sequence: Synthetic polypeptide
DEDEIRTTNPVGTAQWGSVVTGPDGSAGTPIDLDAM

SEQ ID NO: 199990 - protein, 38 aa, Artificial Sequence
  Description of Artificial Sequence: Synthetic polypeptide
DEEEISTTNPVAYEQYGQCVCSNWGEHNAESFNSDTQA

SEQ ID NO: 199991 - protein, 38 aa, Artificial Sequence
  Description of Artificial Sequence: Synthetic polypeptide
DEEEISTTNPVAYEQYGQCVCSNWGEHNAEYFNSETQS

SEQ ID NO: 199992 - protein, 39 aa, Artificial Sequence
  Description of Artificial Sequence: Synthetic polypeptide
DEECIRTTNPVATEQYGQCVCSNWGELDNAENFNSDNQS

SEQ ID NO: 199993 - protein, 38 aa, Artificial Sequence
  Description of Artificial Sequence: Synthetic polypeptide
DEEEISTTNPVAYEQYGQCVCSNWGEHNEEYFNSDTQA

SEQ ID NO: 199994 - protein, 39 aa, Artificial Sequence
  Description of Artificial Sequence: Synthetic polypeptide
DEEEIRTTNPVATLQYGTVAARSFELANIIETSGAQQYI

SEQ ID NO: 199995 - protein, 38 aa, Artificial Sequence
  Description of Artificial Sequence: Synthetic polypeptide
DEEEISTTNPVAYEQYGQCVCSNWGEHNAEHSNSETQS

SEQ ID NO: 199996 - protein, 37 aa, Artificial Sequence
  Description of Artificial Sequence: Synthetic polypeptide
DAEEIATTNPVATEQWGHCNVAAQAGGLPAAPGNGFG

SEQ ID NO: 199997 - protein, 38 aa, Artificial Sequence
  Description of Artificial Sequence: Synthetic polypeptide
DEEEISTTNPVAYEQYGQCVCSNWGEHNAEHFNSETQM

SEQ ID NO: 199998 - protein, 38 aa, Artificial Sequence
  Description of Artificial Sequence: Synthetic polypeptide
DEEEISTTNPVAYEQYGQCVCSNWGEHNAEFFNSDTQS

SEQ ID NO: 199999 - protein, 37 aa, Artificial Sequence
  Description of Artificial Sequence: Synthetic polypeptide
DETEIACTNPVATEQWGSVSGPAIAPPGAAGNPNEQM

SEQ ID NO: 200000 - protein, 37 aa, Artificial Sequence
  Description of Artificial Sequence: Synthetic polypeptide
DETEIACTNPVATEQWGSVSGEGGPLGINHSDDNSAQ

SEQ ID NO: 200001 - protein, 37 aa, Artificial Sequence
  Description of Artificial Sequence: Synthetic polypeptide
CEAEIATTNPVAYEQYGSCAGTGPALGPNHQMGMQMN

SEQ ID NO: 200002 - protein, 39 aa, Artificial Sequence
  Description of Artificial Sequence: Synthetic polypeptide
DEEEIRTTNPVATEGYGVVDVGEGTGNVGEEEGEGEDTE

SEQ ID NO: 200003 - protein, 38 aa, Artificial Sequence
  Description of Artificial Sequence: Synthetic polypeptide
CEEEISTTNPVATEQYGQCVCSNWGEHNAESFGSETQS

SEQ ID NO: 200004 - protein, 37 aa, Artificial Sequence
  Description of Artificial Sequence: Synthetic polypeptide
DEEEIATTNPVAYEPQWGHSACAAANGDAVQGGDQHQ

SEQ ID NO: 200005 - protein, 36 aa, Artificial Sequence
  Description of Artificial Sequence: Synthetic polypeptide
DEEEIATTNPVAYEPQWGHSACAAANGDANQVDQHQ

SEQ ID NO: 200006 - protein, 39 aa, Artificial Sequence
  Description of Artificial Sequence: Synthetic polypeptide
DDEEIRTTNPVATEFYGCVNVNMTGLQVEDLDEGGETTT

SEQ ID NO: 200007 - protein, 38 aa, Artificial Sequence
  Description of Artificial Sequence: Synthetic polypeptide
CEGEIVTTNPVATEQYGSVTMGDQSDQGGGQDGEEEEF

SEQ ID NO: 200008 - protein, 35 aa, Artificial Sequence
  Description of Artificial Sequence: Synthetic polypeptide
TEESIATTNPVSYEQWGSCYTIDNHRQNGGGKTGT

SEQ ID NO: 200009 - protein, 38 aa, Artificial Sequence
  Description of Artificial Sequence: Synthetic polypeptide
DEEEISTTNPVAYEQYGQCVCSNWGEDNAENFNSDTQS

SEQ ID NO: 200010 - protein, 38 aa, Artificial Sequence
  Description of Artificial Sequence: Synthetic polypeptide
CEEEISTTNPVATEQYGQCVCSNWGEHNAEYFNSETQI

SEQ ID NO: 200011 - protein, 38 aa, Artificial Sequence
  Description of Artificial Sequence: Synthetic polypeptide
DEEEISTTNPVAYEQYGQCVCSNWGEDNQENFNSDTQL

SEQ ID NO: 200012 - protein, 37 aa, Artificial Sequence
  Description of Artificial Sequence: Synthetic polypeptide
DEECISTTNPVATEQYGCVCSWGEDENAENFISDTQS

SEQ ID NO: 200013 - protein, 39 aa, Artificial Sequence
  Description of Artificial Sequence: Synthetic polypeptide
DEEEISTTNPVAYEQYGQCVCSNWGEDTNIEYFNSETQS

SEQ ID NO: 200014 - protein, 38 aa, Artificial Sequence
  Description of Artificial Sequence: Synthetic polypeptide
DEEEISTTNPVAYEQYGQCVCSNWGEHNAEHFNSDTQS

SEQ ID NO: 200015 - protein, 37 aa, Artificial Sequence
  Description of Artificial Sequence: Synthetic polypeptide
DEEEISTTNPVATEGYGICVCQWVEDNQENFISDNQA

SEQ ID NO: 200016 - protein, 39 aa, Artificial Sequence
  Description of Artificial Sequence: Synthetic polypeptide
DEEEISTTNPVAYEQYGQCVCSNWGEDHNAENFGSENQS

SEQ ID NO: 200017 - protein, 37 aa, Artificial Sequence
  Description of Artificial Sequence: Synthetic polypeptide
CEEEIACTNPVATEQYGSACSADNPLPAEAPIEDAHE

SEQ ID NO: 200018 - protein, 38 aa, Artificial Sequence
  Description of Artificial Sequence: Synthetic polypeptide
DEEEISTTNPVATEGYGQCVCSNWEDHNAENFNSDNQS

SEQ ID NO: 200019 - protein, 37 aa, Artificial Sequence
  Description of Artificial Sequence: Synthetic polypeptide
DETEIACTNPVATEQYGSACPATNPGVNAMGGDQSAD

SEQ ID NO: 200020 - protein, 38 aa, Artificial Sequence
  Description of Artificial Sequence: Synthetic polypeptide
DEEEISTTNPVATEGYGQCVCSNSGEHNAEGFNSDTQS

SEQ ID NO: 200021 - protein, 34 aa, Artificial Sequence
  Description of Artificial Sequence: Synthetic polypeptide
ENEEIAATNPVAYEQWGVYYTWDDVQGDHQRHDR

SEQ ID NO: 200022 - protein, 37 aa, Artificial Sequence
  Description of Artificial Sequence: Synthetic polypeptide
DQAEICTTNPVAYEQYGQCTAPSCIVELDVHGTANRT

SEQ ID NO: 200023 - protein, 37 aa, Artificial Sequence
  Description of Artificial Sequence: Synthetic polypeptide
DETEIACTNPVATEQYGSACPAINPHHAEAPGGNMNH

SEQ ID NO: 200024 - protein, 38 aa, Artificial Sequence
  Description of Artificial Sequence: Synthetic polypeptide
DETEIACTNPVATEQYGSACNPTPDGLPLGAMEGFANP

SEQ ID NO: 200025 - protein, 38 aa, Artificial Sequence
  Description of Artificial Sequence: Synthetic polypeptide
DEEEISTTNPVAYEQYGQCVCSNSGEHNAEFFNSDTQS

SEQ ID NO: 200026 - protein, 36 aa, Artificial Sequence
  Description of Artificial Sequence: Synthetic polypeptide
SEEEIATTNPVATEQWGTNVCAAGALQNHQDDEQAA

SEQ ID NO: 200027 - protein, 38 aa, Artificial Sequence
  Description of Artificial Sequence: Synthetic polypeptide
DEEEISTTNPVAYEQYGQCVCSNSGEHNAEHFNSDTQS

SEQ ID NO: 200028 - protein, 39 aa, Artificial Sequence
  Description of Artificial Sequence: Synthetic polypeptide
DEEEIRTTNPCATEQYGQCVCSNWGEDDNAENFGSDTQS

SEQ ID NO: 200029 - protein, 36 aa, Artificial Sequence
  Description of Artificial Sequence: Synthetic polypeptide
SEEEIATTNPVATEQWGTNVCAAGALTLHQDDEDAQ

SEQ ID NO: 200030 - protein, 38 aa, Artificial Sequence
  Description of Artificial Sequence: Synthetic polypeptide
DEEEIRTTNPCATEQYGQCVCPNWGEDNAEYFNSDTQS

SEQ ID NO: 200031 - protein, 39 aa, Artificial Sequence
  Description of Artificial Sequence: Synthetic polypeptide
DEEEISTTNPVAYEQYGQCVCSNTGEDDNQEHFNSDFQS

SEQ ID NO: 200032 - protein, 38 aa, Artificial Sequence
  Description of Artificial Sequence: Synthetic polypeptide
DETEIACTNPVATEQYGSACNPTPDGLPLGAGEGMNHD

SEQ ID NO: 200033 - protein, 38 aa, Artificial Sequence
  Description of Artificial Sequence: Synthetic polypeptide
DETEIACTNPVATEQYGSACPATNPHDEAEAHGGNMNH

SEQ ID NO: 200034 - protein, 38 aa, Artificial Sequence
  Description of Artificial Sequence: Synthetic polypeptide
DEECISTTNPVATEQYGQCVCGNSGEHNAENFNSDTQM

SEQ ID NO: 200035 - protein, 38 aa, Artificial Sequence
  Description of Artificial Sequence: Synthetic polypeptide
DEECISTTNPVATEQYGQCVCGNWGEHNAEGFNSDNQA

SEQ ID NO: 200036 - protein, 39 aa, Artificial Sequence
  Description of Artificial Sequence: Synthetic polypeptide
DECEICTTNPVATEQYGVVTVVVATTQLQGNNTTDESDT

SEQ ID NO: 200037 - protein, 39 aa, Artificial Sequence
  Description of Artificial Sequence: Synthetic polypeptide
SEEEIRTTNPVATEGYGMVDNGQDTNDDQEGGGGEQFGD

SEQ ID NO: 200038 - protein, 37 aa, Artificial Sequence
  Description of Artificial Sequence: Synthetic polypeptide
CEEEISTTNPVATCQYGCVCSNSGEHNAENFNSDTQL

SEQ ID NO: 200039 - protein, 38 aa, Artificial Sequence
  Description of Artificial Sequence: Synthetic polypeptide
DEEEISTTNPVATEGYGQCVCSNWEEHNIENFGSDTQS

SEQ ID NO: 200040 - protein, 39 aa, Artificial Sequence
  Description of Artificial Sequence: Synthetic polypeptide
DEEEISTTNPVAYEQYGQCVCSMWGEDHNAENFGSDNQS

SEQ ID NO: 200041 - protein, 38 aa, Artificial Sequence
  Description of Artificial Sequence: Synthetic polypeptide
DEEEISTTNPVATEGYGQCVCSNWEEHNAENFNSDTQS

SEQ ID NO: 200042 - protein, 38 aa, Artificial Sequence
  Description of Artificial Sequence: Synthetic polypeptide
DEEEISTTNPVATEGYGQCVCSNWEEHNAENFNSDTQI

SEQ ID NO: 200043 - protein, 38 aa, Artificial Sequence
  Description of Artificial Sequence: Synthetic polypeptide
DEEEISTTNPVATEGYGQCVCSNWEEHNAENFNSDNQS

SEQ ID NO: 200044 - protein, 38 aa, Artificial Sequence
  Description of Artificial Sequence: Synthetic polypeptide
DETEIACTNPVATEQYGSACPATNPHEEAEAPQGNMHM

SEQ ID NO: 200045 - protein, 38 aa, Artificial Sequence
  Description of Artificial Sequence: Synthetic polypeptide
DETEIACTNPVATEQYGSACPATNPHEEAEAPQENDNH

SEQ ID NO: 200046 - protein, 38 aa, Artificial Sequence
  Description of Artificial Sequence: Synthetic polypeptide
DAEEIATTNPVATEQYGSVCPPVGDNNHNIDAMGEGAG

SEQ ID NO: 200047 - protein, 38 aa, Artificial Sequence
  Description of Artificial Sequence: Synthetic polypeptide
DDECIRTTNPVATEQYGQCVCSWGEDHNEENFNSDTQA

SEQ ID NO: 200048 - protein, 36 aa, Artificial Sequence
  Description of Artificial Sequence: Synthetic polypeptide
EEEEIRCTNPTAYEQWGSTVYGINDIDHQGGDGKTH

SEQ ID NO: 200049 - protein, 38 aa, Artificial Sequence
  Description of Artificial Sequence: Synthetic polypeptide
DETEIACTNPVATEQYGSACPATNPHEEAEAPIGNSNH

SEQ ID NO: 200050 - protein, 38 aa, Artificial Sequence
  Description of Artificial Sequence: Synthetic polypeptide
DETEIACTNPVATEQYGSACPATNPHEEAEAPGGEMNP

SEQ ID NO: 200051 - protein, 37 aa, Artificial Sequence
  Description of Artificial Sequence: Synthetic polypeptide
SEEEIRTTNPVATEGYGCVCSNWGEDHAEYFGSDTQS

SEQ ID NO: 200052 - protein, 37 aa, Artificial Sequence
  Description of Artificial Sequence: Synthetic polypeptide
CEEEISTTNPVATEEYGCVCSWGEDHNQENFISDNQA

SEQ ID NO: 200053 - protein, 38 aa, Artificial Sequence
  Description of Artificial Sequence: Synthetic polypeptide
DETEIACTNPVATEQWGNTTAKTGNILTAPDDQMGNSM

SEQ ID NO: 200054 - protein, 38 aa, Artificial Sequence
  Description of Artificial Sequence: Synthetic polypeptide
DEEEIRTTNPCATEQYGQCVCGWGEDHNAENFNSDTAS

SEQ ID NO: 200055 - protein, 38 aa, Artificial Sequence
  Description of Artificial Sequence: Synthetic polypeptide
DEEEISTTNPVAYEQYGQCVCSNWEEDNAENFNSDTQS

SEQ ID NO: 200056 - protein, 38 aa, Artificial Sequence
  Description of Artificial Sequence: Synthetic polypeptide
DETEIACTNPVATEQYGSACAATNPMGVNAAGGDNSAD

SEQ ID NO: 200057 - protein, 37 aa, Artificial Sequence
  Description of Artificial Sequence: Synthetic polypeptide
DETEIACTNPVATEQYGSACAATNPGVNAAGGDEDAD

SEQ ID NO: 200058 - protein, 38 aa, Artificial Sequence
  Description of Artificial Sequence: Synthetic polypeptide
DEAEIRTTNPVATEQYGQCTCSNWGEHNQENFNSDNQS

SEQ ID NO: 200059 - protein, 37 aa, Artificial Sequence
  Description of Artificial Sequence: Synthetic polypeptide
AEEEIATTNPVATEQYGCYCPWGELDNQEHFNSETQA

SEQ ID NO: 200060 - protein, 39 aa, Artificial Sequence
  Description of Artificial Sequence: Synthetic polypeptide
DEEAIRTTNPVATEQYGQCVCSNWEEDHNAENFNSDNQS

SEQ ID NO: 200061 - protein, 32 aa, Artificial Sequence
  Description of Artificial Sequence: Synthetic polypeptide
QEWEIATTNPVAYERWGEAYMVEQHDEGETGN

SEQ ID NO: 200062 - protein, 38 aa, Artificial Sequence
  Description of Artificial Sequence: Synthetic polypeptide
DEEEISTTNPVATEGYGQCIVCSNWGEHNTENFNSEQA

SEQ ID NO: 200063 - protein, 38 aa, Artificial Sequence
  Description of Artificial Sequence: Synthetic polypeptide
DETEIACTNPVATEQYGSACAATNPAEEAGRHTDNDTP

SEQ ID NO: 200064 - protein, 35 aa, Artificial Sequence
  Description of Artificial Sequence: Synthetic polypeptide
EEEEIRCTNPTAYEQWGFTVYGENDDHQGGDGKTK

SEQ ID NO: 200065 - protein, 38 aa, Artificial Sequence
  Description of Artificial Sequence: Synthetic polypeptide
DEAEISTTNPVATEQYGCVCSNSGEEHNAENFNSDNQS

SEQ ID NO: 200066 - protein, 37 aa, Artificial Sequence
  Description of Artificial Sequence: Synthetic polypeptide
DAEEIATTNPVATEQWGHCNVAANNGLPATAPGGVHW

SEQ ID NO: 200067 - protein, 35 aa, Artificial Sequence
  Description of Artificial Sequence: Synthetic polypeptide
TEENIATTNPEATDAYGQVCCCDQDQKREGDGDER

SEQ ID NO: 200068 - protein, 37 aa, Artificial Sequence
  Description of Artificial Sequence: Synthetic polypeptide
DEEEISTTNPVATEGYGICVCSWVEDDNAENFISDQA

SEQ ID NO: 200069 - protein, 39 aa, Artificial Sequence
  Description of Artificial Sequence: Synthetic polypeptide
DEEEISTTNPVAYEQYGQCVCSNWGEDHNAENFGSDNQS

SEQ ID NO: 200070 - protein, 37 aa, Artificial Sequence
  Description of Artificial Sequence: Synthetic polypeptide
DEEEISTTNPVATEGYGICVCSNWMEDNAENFISDQS

SEQ ID NO: 200071 - protein, 38 aa, Artificial Sequence
  Description of Artificial Sequence: Synthetic polypeptide
DELNEIATTNPVAYEQWGEVCSTPNQGNHGEAGGDHNN

SEQ ID NO: 200072 - protein, 38 aa, Artificial Sequence
  Description of Artificial Sequence: Synthetic polypeptide
DETEIACTNPVATEQYGSACNPTPDGEPLGAMEGGHND

SEQ ID NO: 200073 - protein, 40 aa, Artificial Sequence
  Description of Artificial Sequence: Synthetic polypeptide
DECEICTTNPVATEQYGVVSTVVVTTTQLQGNNNTDESDT

SEQ ID NO: 200074 - protein, 37 aa, Artificial Sequence
  Description of Artificial Sequence: Synthetic polypeptide
DETEIACTNPVATEQYGSACAAVATGVNTAGFDTETA

SEQ ID NO: 200075 - protein, 38 aa, Artificial Sequence
  Description of Artificial Sequence: Synthetic polypeptide
QEVEIWTTNPVATEQYGTVVVSTDGGDEEEEEGGNNDP

SEQ ID NO: 200076 - protein, 38 aa, Artificial Sequence
  Description of Artificial Sequence: Synthetic polypeptide
DEEEISTTNPVAYEQYGQCVCSNWEEHNQEHFGSDTQS

SEQ ID NO: 200077 - protein, 36 aa, Artificial Sequence
  Description of Artificial Sequence: Synthetic polypeptide
DQAEIKTTNPVAYEQYGQCTASCIMELVQTSTANET

SEQ ID NO: 200078 - protein, 36 aa, Artificial Sequence
  Description of Artificial Sequence: Synthetic polypeptide
DQAEIKTTNPVAYEQYGQCTASCIMEPDQTGTANVT

SEQ ID NO: 200079 - protein, 38 aa, Artificial Sequence
  Description of Artificial Sequence: Synthetic polypeptide
DEEEIRTTNPCATEQYGQCVCGNWEEHNAEYFNSDTAS

SEQ ID NO: 200080 - protein, 37 aa, Artificial Sequence
  Description of Artificial Sequence: Synthetic polypeptide
DETEIACTNPVATEQYGSACATNPDEEAGAHQDETAP

SEQ ID NO: 200081 - protein, 39 aa, Artificial Sequence
  Description of Artificial Sequence: Synthetic polypeptide
DEEEISTTNPVATEGYGQCVCGNSGEDHNQENFGSDNQS

SEQ ID NO: 200082 - protein, 37 aa, Artificial Sequence
  Description of Artificial Sequence: Synthetic polypeptide
DQAEIKTTNPVAYEQYGQCTASSCIMELAHTGTANRT

SEQ ID NO: 200083 - protein, 36 aa, Artificial Sequence
  Description of Artificial Sequence: Synthetic polypeptide
DEEEIATTNPVAYEPWGHSACAAANGDADQGGDQHQ

SEQ ID NO: 200084 - protein, 37 aa, Artificial Sequence
  Description of Artificial Sequence: Synthetic polypeptide
DEMEISTTNPVATEQYGQCVCQNWAHNIENFMSDTQS

SEQ ID NO: 200085 - protein, 38 aa, Artificial Sequence
  Description of Artificial Sequence: Synthetic polypeptide
DEEEISTTNPVATEGYGQCSCSNWGEENAEYFNSDTFA

SEQ ID NO: 200086 - protein, 36 aa, Artificial Sequence
  Description of Artificial Sequence: Synthetic polypeptide
SEEEIATTNPVATEQWGTNVCAAGAQTEHQDDEAAQ

SEQ ID NO: 200087 - protein, 37 aa, Artificial Sequence
  Description of Artificial Sequence: Synthetic polypeptide
DQAEIRTTNPVATEQYGCCCSNWGEHNQEHFGSDTQS

SEQ ID NO: 200088 - protein, 38 aa, Artificial Sequence
  Description of Artificial Sequence: Synthetic polypeptide
DEAEIRTTNPVATEQYGQCTCSWGEDHNQEHFGSDTQS

SEQ ID NO: 200089 - protein, 38 aa, Artificial Sequence
  Description of Artificial Sequence: Synthetic polypeptide
DEECISTTNPVATEQYGQCSCSMWEEDNAEYINSDTQA

SEQ ID NO: 200090 - protein, 38 aa, Artificial Sequence
  Description of Artificial Sequence: Synthetic polypeptide
SEEEIRTTNPVATEGYGCQVCSNWEEHNAENFGSDTQA

SEQ ID NO: 200091 - protein, 39 aa, Artificial Sequence
  Description of Artificial Sequence: Synthetic polypeptide
DEEEISTTNPVATEGYGQCVCSNWGADHNTENFNSDNQG

SEQ ID NO: 200092 - protein, 39 aa, Artificial Sequence
  Description of Artificial Sequence: Synthetic polypeptide
DEEEIRTTNPVATEAYGVVATVTTNQAGTEEGTVTDEEE

SEQ ID NO: 200093 - protein, 38 aa, Artificial Sequence
  Description of Artificial Sequence: Synthetic polypeptide
DEEEISTTNPVAYEQYGQCVCSNWGEHNIENFGSDPQA

SEQ ID NO: 200094 - protein, 39 aa, Artificial Sequence
  Description of Artificial Sequence: Synthetic polypeptide
DDEEIKTTNPVATEQYGAVNMTNIIQQEGDQEEGGGQIT

SEQ ID NO: 200095 - protein, 38 aa, Artificial Sequence
  Description of Artificial Sequence: Synthetic polypeptide
DQEEIRTTNPVATCQYGCVCSNWGEGHNIENFNSDNQS

SEQ ID NO: 200096 - protein, 38 aa, Artificial Sequence
  Description of Artificial Sequence: Synthetic polypeptide
DEEEISTTNPVGTEQYGQCVCSNSGEDHNANFGSDTQA

SEQ ID NO: 200097 - protein, 39 aa, Artificial Sequence
  Description of Artificial Sequence: Synthetic polypeptide
DEEEISTTNPVGTEQYGQCVCSNWGEDTNAENFGSQTQS

SEQ ID NO: 200098 - protein, 37 aa, Artificial Sequence
  Description of Artificial Sequence: Synthetic polypeptide
DEEEISTTNPVSTEGYGCVCGNWGEHNQEGFISQTQA

SEQ ID NO: 200099 - protein, 35 aa, Artificial Sequence
  Description of Artificial Sequence: Synthetic polypeptide
SEAEIATTNPVAYEHWGVVWPGPNNENDGQSNGSR

SEQ ID NO: 200100 - protein, 37 aa, Artificial Sequence
  Description of Artificial Sequence: Synthetic polypeptide
VEDEIATTNPVAYEQYGSVAANPNQGLDNLNNGDGMT

SEQ ID NO: 200101 - protein, 40 aa, Artificial Sequence
  Description of Artificial Sequence: Synthetic polypeptide
DEEEIRTTNPVATEAYGTVVVTVTTNQAGTEQGTVNDEVD

SEQ ID NO: 200102 - protein, 35 aa, Artificial Sequence
  Description of Artificial Sequence: Synthetic polypeptide
SEAEIATTNPVAYEAWGVVWPGPNNENDGTQNGDR

SEQ ID NO: 200103 - protein, 38 aa, Artificial Sequence
  Description of Artificial Sequence: Synthetic polypeptide
DEEEISTVNPVATEGYGCVCSTWGEDHNQEYFNSQTQS

SEQ ID NO: 200104 - protein, 39 aa, Artificial Sequence
  Description of Artificial Sequence: Synthetic polypeptide
DEECIRTTNPVATEQYGQCVCSNWGEEDNAEFFNSDTQS

SEQ ID NO: 200105 - protein, 38 aa, Artificial Sequence
  Description of Artificial Sequence: Synthetic polypeptide
MTNEIRTTNPVATEQYGSVCTKSVDGWTDEHPNECNIN

SEQ ID NO: 200106 - protein, 38 aa, Artificial Sequence
  Description of Artificial Sequence: Synthetic polypeptide
DEEEISTVNPVATEQYGCVCSNWGEPDNAENFNSQTQS

SEQ ID NO: 200107 - protein, 39 aa, Artificial Sequence
  Description of Artificial Sequence: Synthetic polypeptide
DEDSCIRTTNPVAYEQWGSQVTATTGNMESDYNEGNNRN

SEQ ID NO: 200108 - protein, 37 aa, Artificial Sequence
  Description of Artificial Sequence: Synthetic polypeptide
VEDEIATTNPVAYEQYGSVAAIANNWTIQENGDQTAQ

SEQ ID NO: 200109 - protein, 37 aa, Artificial Sequence
  Description of Artificial Sequence: Synthetic polypeptide
CDEEISTTNPVATEQYGQCVCSWGEHNQEHFGSETQA

SEQ ID NO: 200110 - protein, 37 aa, Artificial Sequence
  Description of Artificial Sequence: Synthetic polypeptide
SEEEIRSTNPVATEQYGMVSVEGMGDGGQGQEAETGE

SEQ ID NO: 200111 - protein, 37 aa, Artificial Sequence
  Description of Artificial Sequence: Synthetic polypeptide
DEEEISTTNPVGTEHYGCVCSNWGEHNQENFGSDTQS

SEQ ID NO: 200112 - protein, 38 aa, Artificial Sequence
  Description of Artificial Sequence: Synthetic polypeptide
DDEEIRTTNPVATEFYGCVNVNMTGGQEDQDEGGETIT

SEQ ID NO: 200113 - protein, 34 aa, Artificial Sequence
  Description of Artificial Sequence: Synthetic polypeptide
CEDWIATTNPVATAQWGCIAIANNGQEAPGGNMN

SEQ ID NO: 200114 - protein, 38 aa, Artificial Sequence
  Description of Artificial Sequence: Synthetic polypeptide
DEEEIACTNPVATEQWGNTTAKTGNILTAPADQMENEM

SEQ ID NO: 200115 - protein, 32 aa, Artificial Sequence
  Description of Artificial Sequence: Synthetic polypeptide
QESEIASTNPVGTEGWGVTMWANSTWQHKGDI

SEQ ID NO: 200116 - protein, 38 aa, Artificial Sequence
  Description of Artificial Sequence: Synthetic polypeptide
DEDEIATTNPVATASWGSCVAAANNIEVQDRGGENTHQ

SEQ ID NO: 200117 - protein, 34 aa, Artificial Sequence
  Description of Artificial Sequence: Synthetic polypeptide
ENEEIATTNPVAYEQWGVTYYTWQQGDHQRHDAP

SEQ ID NO: 200118 - protein, 37 aa, Artificial Sequence
  Description of Artificial Sequence: Synthetic polypeptide
DEEEISTTNPVCTEGYGCVCSNWGEHNAENFNSDTQA

SEQ ID NO: 200119 - protein, 39 aa, Artificial Sequence
  Description of Artificial Sequence: Synthetic polypeptide
DENEIRTTNPVATEQYGQASCMCVAGVTLQEVVVQEDTN

SEQ ID NO: 200120 - protein, 38 aa, Artificial Sequence
  Description of Artificial Sequence: Synthetic polypeptide
DDEEIRTTNPVATEFYGCVNVNMTGDQEDQDEGGTTTT

SEQ ID NO: 200121 - protein, 37 aa, Artificial Sequence
  Description of Artificial Sequence: Synthetic polypeptide
DEEEISTTNPVCTEHYGCVCSNWEEHNAENFGSDTQA

SEQ ID NO: 200122 - protein, 39 aa, Artificial Sequence
  Description of Artificial Sequence: Synthetic polypeptide
DDEEIRTTNPVATEFYGCVNVNMGLQIEEQDGFGGETTT

SEQ ID NO: 200123 - protein, 39 aa, Artificial Sequence
  Description of Artificial Sequence: Synthetic polypeptide
DENEIRTTNPVATEQYGQASCMCVAGVDLQEFVMQEDIN

SEQ ID NO: 200124 - protein, 36 aa, Artificial Sequence
  Description of Artificial Sequence: Synthetic polypeptide
DETEIACTNPVATEQWGAVVCAQNPVQETAGFPTGS

SEQ ID NO: 200125 - protein, 36 aa, Artificial Sequence
  Description of Artificial Sequence: Synthetic polypeptide
DETEIACTNPVATEQWGAVCAQNPGVNTAGNPTGSV

SEQ ID NO: 200126 - protein, 34 aa, Artificial Sequence
  Description of Artificial Sequence: Synthetic polypeptide
DETEIACTNPVATEQWGAICAQNPVETAGDPTGT

SEQ ID NO: 200127 - protein, 35 aa, Artificial Sequence
  Description of Artificial Sequence: Synthetic polypeptide
QQGEIAPTNPCSYEQYGVTVSCCNMLSQSVGGTYR

SEQ ID NO: 200128 - protein, 40 aa, Artificial Sequence
  Description of Artificial Sequence: Synthetic polypeptide
DEEEIRTTNPVATEAYGTVVVTVTTNQAGTEAGTVNQQVE

SEQ ID NO: 200129 - protein, 38 aa, Artificial Sequence
  Description of Artificial Sequence: Synthetic polypeptide
CDEEISTTNPVATEQYGQCVCSTWGEHNAENFNSDFQS

SEQ ID NO: 200130 - protein, 37 aa, Artificial Sequence
  Description of Artificial Sequence: Synthetic polypeptide
DEECISTTNPVATEQYGCVCSNWGEDNQEFFISETQS

SEQ ID NO: 200131 - protein, 37 aa, Artificial Sequence
  Description of Artificial Sequence: Synthetic polypeptide
DDEEISTTNPVATEGYGCVCSNWEEHNAENFNSQTQS

SEQ ID NO: 200132 - protein, 35 aa, Artificial Sequence
  Description of Artificial Sequence: Synthetic polypeptide
DETEIACTNPVATASWGCVAGNNNLQQDAGGGKHH

SEQ ID NO: 200133 - protein, 39 aa, Artificial Sequence
  Description of Artificial Sequence: Synthetic polypeptide
SEEEIRGTNPVATEQYGQVSVDIMGVDEMDQRNVGGGDG

SEQ ID NO: 200134 - protein, 38 aa, Artificial Sequence
  Description of Artificial Sequence: Synthetic polypeptide
DEEEISTTNPVATEGYGCVCSNWGEDHNAENFNSDTQL

SEQ ID NO: 200135 - protein, 33 aa, Artificial Sequence
  Description of Artificial Sequence: Synthetic polypeptide
QESEIASTNPVGTEGWGVCAYTDRDQHQGQDNI

SEQ ID NO: 200136 - protein, 36 aa, Artificial Sequence
  Description of Artificial Sequence: Synthetic polypeptide
DEEACEIAATNPVAYEPWGVCAAEINDQSDGRNGNM

SEQ ID NO: 200137 - protein, 36 aa, Artificial Sequence
  Description of Artificial Sequence: Synthetic polypeptide
DEEACEIAATNPVAYEPWGVCAMNINDQVDGRNGNM

SEQ ID NO: 200138 - protein, 35 aa, Artificial Sequence
  Description of Artificial Sequence: Synthetic polypeptide
DETEIACTNPVATASWGCVAGNNNLQEDANGGKHK

SEQ ID NO: 200139 - protein, 38 aa, Artificial Sequence
  Description of Artificial Sequence: Synthetic polypeptide
DEEEISTTNPVATEGYGCVCSNWGEDHNAENFNSDNQA

SEQ ID NO: 200140 - protein, 38 aa, Artificial Sequence
  Description of Artificial Sequence: Synthetic polypeptide
DEEEISTTNPVATEGYGCVCSNWGEDHNAEFFNSDTQS

SEQ ID NO: 200141 - protein, 38 aa, Artificial Sequence
  Description of Artificial Sequence: Synthetic polypeptide
DEEEISTTNPVATEGYGCVCSNWGEDDNAENFNSENQA

SEQ ID NO: 200142 - protein, 35 aa, Artificial Sequence
  Description of Artificial Sequence: Synthetic polypeptide
DETEIACTNPVATASWGCVAGNNNLQEDAGGGKMV

SEQ ID NO: 200143 - protein, 37 aa, Artificial Sequence
  Description of Artificial Sequence: Synthetic polypeptide
DETEIACTNPVATAQWGSVSVSGNPQENTAGVIEEMK

SEQ ID NO: 200144 - protein, 37 aa, Artificial Sequence
  Description of Artificial Sequence: Synthetic polypeptide
DDEEISTTNPVATEGYGCVCSNWGEHNAEGFNSETQA

SEQ ID NO: 200145 - protein, 37 aa, Artificial Sequence
  Description of Artificial Sequence: Synthetic polypeptide
DDEEISTTNPVATEGYGCVCSNWGEHNAENFISENQS

SEQ ID NO: 200146 - protein, 38 aa, Artificial Sequence
  Description of Artificial Sequence: Synthetic polypeptide
DEEEISTTNPVATEGYGCVCSNWGEDHNAENFNSDTQS

SEQ ID NO: 200147 - protein, 39 aa, Artificial Sequence
  Description of Artificial Sequence: Synthetic polypeptide
DENEIRTTNPVATEQYGQCVCPNTGEDHNQEFFNSDNQA

SEQ ID NO: 200148 - protein, 38 aa, Artificial Sequence
  Description of Artificial Sequence: Synthetic polypeptide
CDEEISTTNPVATEQYGQCVCSNWGPHNEEHFGSDNQE

SEQ ID NO: 200149 - protein, 35 aa, Artificial Sequence
  Description of Artificial Sequence: Synthetic polypeptide
TEGEIAPTNPCSYEQYGVTVSCCGMLSQSNGGTDR

SEQ ID NO: 200150 - protein, 37 aa, Artificial Sequence
  Description of Artificial Sequence: Synthetic polypeptide
DEECISTTNPVATEQYGCVCSNWGEDNAEYFISDTQA

SEQ ID NO: 200151 - protein, 38 aa, Artificial Sequence
  Description of Artificial Sequence: Synthetic polypeptide
QEEEIRTTNPVATEQYGMITVNMGMEDLNEEGEGEGTD

SEQ ID NO: 200152 - protein, 33 aa, Artificial Sequence
  Description of Artificial Sequence: Synthetic polypeptide
DDSEIASTNPISTEGYGNVWANNEDIQSPKGQI

SEQ ID NO: 200153 - protein, 38 aa, Artificial Sequence
  Description of Artificial Sequence: Synthetic polypeptide
DEEEISTVNPVATEQYGQCVCSNWEEDNAEYFNSQTQS

SEQ ID NO: 200154 - protein, 38 aa, Artificial Sequence
  Description of Artificial Sequence: Synthetic polypeptide
DEEEIACTNPVATEQWGSVCAMNNGEPTNPDDQGEHHM

SEQ ID NO: 200155 - protein, 38 aa, Artificial Sequence
  Description of Artificial Sequence: Synthetic polypeptide
DEEEISTTNPVATEGYGCVCSNWGEDHNQENFNSETQA

SEQ ID NO: 200156 - protein, 32 aa, Artificial Sequence
  Description of Artificial Sequence: Synthetic polypeptide
DDSEIASTNPISTECWGNTTAANTWASRVGPR

SEQ ID NO: 200157 - protein, 38 aa, Artificial Sequence
  Description of Artificial Sequence: Synthetic polypeptide
DEEEISTTNPVATEGYGCVCSNWGEDHNQENFNSDNQA

SEQ ID NO: 200158 - protein, 38 aa, Artificial Sequence
  Description of Artificial Sequence: Synthetic polypeptide
DEEEISTTNPVATEGYGCVCSNWGEDHNQENFFSENQA

SEQ ID NO: 200159 - protein, 39 aa, Artificial Sequence
  Description of Artificial Sequence: Synthetic polypeptide
DENEIRTTNPVATEQYGMVSVEGGMGDGGQGQENQEIGT

SEQ ID NO: 200160 - protein, 33 aa, Artificial Sequence
  Description of Artificial Sequence: Synthetic polypeptide
DDSEIASTNPIATEGYGNTTWANADWQSPKGQI

SEQ ID NO: 200161 - protein, 33 aa, Artificial Sequence
  Description of Artificial Sequence: Synthetic polypeptide
DDSEIASTNPIATEGYGATTWANADWQSPKGPI

SEQ ID NO: 200162 - protein, 38 aa, Artificial Sequence
  Description of Artificial Sequence: Synthetic polypeptide
DEEEISTTNPVATEGYGCVCSNWGEDHNQEHFNSDNQA

SEQ ID NO: 200163 - protein, 38 aa, Artificial Sequence
  Description of Artificial Sequence: Synthetic polypeptide
DEEEISTTNPVATEGYGCVCSNWGEDHNQEFFNSDTQS

SEQ ID NO: 200164 - protein, 38 aa, Artificial Sequence
  Description of Artificial Sequence: Synthetic polypeptide
DEEEISTTNPVATEGYGCVCSNWGEDHNAESFNSENQM

SEQ ID NO: 200165 - protein, 35 aa, Artificial Sequence
  Description of Artificial Sequence: Synthetic polypeptide
SEAEIATTNPVAYEAWGVVWPGPNNENDGQQDGSR

SEQ ID NO: 200166 - protein, 37 aa, Artificial Sequence
  Description of Artificial Sequence: Synthetic polypeptide
DEEEIACTNPVATEQWGHVVANTGALADAGTHQQEQE

SEQ ID NO: 200167 - protein, 39 aa, Artificial Sequence
  Description of Artificial Sequence: Synthetic polypeptide
DENEIRTTNPVATEQYGQCVCSNWGEDHNAENFNSDFQS

SEQ ID NO: 200168 - protein, 40 aa, Artificial Sequence
  Description of Artificial Sequence: Synthetic polypeptide
DEEEIRTTNPVATEAYGVVATTNIGTTEQGSTNDETNEET

SEQ ID NO: 200169 - protein, 38 aa, Artificial Sequence
  Description of Artificial Sequence: Synthetic polypeptide
DEEEISTTNPVAYEQYGQCVCSNWGYHNAENFNSDNQA

SEQ ID NO: 200170 - protein, 38 aa, Artificial Sequence
  Description of Artificial Sequence: Synthetic polypeptide
DEEEISTTNPVAYEQYGQCVCSNWMEHNAENFISENQA

SEQ ID NO: 200171 - protein, 38 aa, Artificial Sequence
  Description of Artificial Sequence: Synthetic polypeptide
DEEEISTTNPVAYEQYGQCVCSNWMEHNAENFNSDTQS

SEQ ID NO: 200172 - protein, 37 aa, Artificial Sequence
  Description of Artificial Sequence: Synthetic polypeptide
DDAEISTTNPVATEQYGCVCSNWGEHNQENFNSDNQP

SEQ ID NO: 200173 - protein, 38 aa, Artificial Sequence
  Description of Artificial Sequence: Synthetic polypeptide
DEEEISTTNPVAYEQYGQCVCSNWNEHNAENFISENQA

SEQ ID NO: 200174 - protein, 36 aa, Artificial Sequence
  Description of Artificial Sequence: Synthetic polypeptide
DETEIACTNPVATEQWGHCNVAATPGLPAHAPMGVF

SEQ ID NO: 200175 - protein, 37 aa, Artificial Sequence
  Description of Artificial Sequence: Synthetic polypeptide
DETEIACTNPVATEQWGHCNVAATANQLPAEAPMGVT

SEQ ID NO: 200176 - protein, 39 aa, Artificial Sequence
  Description of Artificial Sequence: Synthetic polypeptide
DEEEISTTNPVAYEQYGQCVCSTWMEDHNQENFNSQTQA

SEQ ID NO: 200177 - protein, 40 aa, Artificial Sequence
  Description of Artificial Sequence: Synthetic polypeptide
DEEEIRTTNPVATLQYGTVAARSPELANIIEETSGADNYE

SEQ ID NO: 200178 - protein, 40 aa, Artificial Sequence
  Description of Artificial Sequence: Synthetic polypeptide
DEEEIRTTNPVATLQYGTVAARTFELATIIEETSGAQNYE

SEQ ID NO: 200179 - protein, 37 aa, Artificial Sequence
  Description of Artificial Sequence: Synthetic polypeptide
AEEEISTTNPVATEQYGCVCSWGEDHNQENFFSETQS

SEQ ID NO: 200180 - protein, 38 aa, Artificial Sequence
  Description of Artificial Sequence: Synthetic polypeptide
DEEEISTTNPVAYEQYGQCVCSWEEDHNAENFGSDTQS

SEQ ID NO: 200181 - protein, 39 aa, Artificial Sequence
  Description of Artificial Sequence: Synthetic polypeptide
DEMEISTTNPVATEQYGQCVCSNWEEDHNQENFGSDNQS

SEQ ID NO: 200182 - protein, 37 aa, Artificial Sequence
  Description of Artificial Sequence: Synthetic polypeptide
DEEEISTTNPVAYEQYGQCVCSWGEDDNAENFISEQA

SEQ ID NO: 200183 - protein, 37 aa, Artificial Sequence
  Description of Artificial Sequence: Synthetic polypeptide
AEEEIATTNPVATEQYGCSCPNWMEDDNQEHFNSEQA

SEQ ID NO: 200184 - protein, 35 aa, Artificial Sequence
  Description of Artificial Sequence: Synthetic polypeptide
CEAEIACTNPVATEQYGSCAAGPIGIAHAGDNSDA

SEQ ID NO: 200185 - protein, 35 aa, Artificial Sequence
  Description of Artificial Sequence: Synthetic polypeptide
ENEEIATTNPVAYEQWGHYYIITNDQHEHVNNDDH

SEQ ID NO: 200186 - protein, 40 aa, Artificial Sequence
  Description of Artificial Sequence: Synthetic polypeptide
DEEEIRTTNPVATLQYGTVAARSFELSNLVEETSKAQQRE

SEQ ID NO: 200187 - protein, 38 aa, Artificial Sequence
  Description of Artificial Sequence: Synthetic polypeptide
DEEEISTTNPVAYEQYGQCVCSNWGEPNQENFGSETQA

SEQ ID NO: 200188 - protein, 38 aa, Artificial Sequence
  Description of Artificial Sequence: Synthetic polypeptide
DEDEIATTNPVAYEQYGSVCSPANPALPTEHMIDLTAM

SEQ ID NO: 200189 - protein, 38 aa, Artificial Sequence
  Description of Artificial Sequence: Synthetic polypeptide
DEEEISTTNPVAYEQYGQCVCSNWGEHNQEGFGSDTQS

SEQ ID NO: 200190 - protein, 37 aa, Artificial Sequence
  Description of Artificial Sequence: Synthetic polypeptide
DDEEIRCTNPVATEQYGQCVCSNWEHNAENSISQTQS

SEQ ID NO: 200191 - protein, 38 aa, Artificial Sequence
  Description of Artificial Sequence: Synthetic polypeptide
DEEEISTTNPVAYEQYGQCVCSNWGEHNQEHSNSDNQS

SEQ ID NO: 200192 - protein, 38 aa, Artificial Sequence
  Description of Artificial Sequence: Synthetic polypeptide
DEEEISTTNPVAYEQYGQCVCSNWGEHNQENFGSDFQA

SEQ ID NO: 200193 - protein, 37 aa, Artificial Sequence
  Description of Artificial Sequence: Synthetic polypeptide
DETEIACTNPVATEQWGHSVSATGDEEAGTEGGEDAM

SEQ ID NO: 200194 - protein, 38 aa, Artificial Sequence
  Description of Artificial Sequence: Synthetic polypeptide
DEEEISTTNPVAYEQYGQCVCSNWGEHNQENFGSETQM

SEQ ID NO: 200195 - protein, 38 aa, Artificial Sequence
  Description of Artificial Sequence: Synthetic polypeptide
DEEEISTTNPVAYEQYGQCVCSNWGEHNQENFNSQNQG

SEQ ID NO: 200196 - protein, 34 aa, Artificial Sequence
  Description of Artificial Sequence: Synthetic polypeptide
CEEVIACTNPVATEQWGCVAGTDGPAAMMGEPMW

SEQ ID NO: 200197 - protein, 38 aa, Artificial Sequence
  Description of Artificial Sequence: Synthetic polypeptide
DEEEISTTNPVAYEQYGQCVCSNWGEHNQESFISDNQY

SEQ ID NO: 200198 - protein, 38 aa, Artificial Sequence
  Description of Artificial Sequence: Synthetic polypeptide
DEEEISTTNPVAYEQYGQCVCSNWGEHNQEYFNSENQA

SEQ ID NO: 200199 - protein, 38 aa, Artificial Sequence
  Description of Artificial Sequence: Synthetic polypeptide
DEEEISTTNPVAYEQYGQCVCSNWGEHNQEYFNSETQA

SEQ ID NO: 200200 - protein, 38 aa, Artificial Sequence
  Description of Artificial Sequence: Synthetic polypeptide
DEEEISTTNPVAYEQYGQCVCSNWGEHNQEYFNSETQS

SEQ ID NO: 200201 - protein, 38 aa, Artificial Sequence
  Description of Artificial Sequence: Synthetic polypeptide
DEEEISTTNPVAYEQYGQCVCSNWGEHNTEHFGSETQA

SEQ ID NO: 200202 - protein, 38 aa, Artificial Sequence
  Description of Artificial Sequence: Synthetic polypeptide
DEEEISTTNPVAYEQYGQCVCSNWGEHNTEHFNSDFQS

SEQ ID NO: 200203 - protein, 38 aa, Artificial Sequence
  Description of Artificial Sequence: Synthetic polypeptide
DEAEIRTTNPVATEQYGNTIPWTPPWEENQHSQIEHMQ

SEQ ID NO: 200204 - protein, 36 aa, Artificial Sequence
  Description of Artificial Sequence: Synthetic polypeptide
QEYEIGTTNPVATEQYGAVVVAANAGMNEGGEDGGQ

SEQ ID NO: 200205 - protein, 38 aa, Artificial Sequence
  Description of Artificial Sequence: Synthetic polypeptide
DEEEISTTNPVAYEQYGQCVCSWGEDHNQENFGSDTQG

SEQ ID NO: 200206 - protein, 40 aa, Artificial Sequence
  Description of Artificial Sequence: Synthetic polypeptide
DEEEIRTTNPVATLQYGTVALRSFELANIPEETSGAQNYE

SEQ ID NO: 200207 - protein, 35 aa, Artificial Sequence
  Description of Artificial Sequence: Synthetic polypeptide
CENEIRTTNPVSYEPWGKISCMEDSISDQMNSGNF

SEQ ID NO: 200208 - protein, 36 aa, Artificial Sequence
  Description of Artificial Sequence: Synthetic polypeptide
SEEEIATTNPVATEQYGQCSCQWGEDNAHFISETQS

SEQ ID NO: 200209 - protein, 39 aa, Artificial Sequence
  Description of Artificial Sequence: Synthetic polypeptide
DEEEICTTNPVATEGYGVVDVGVGTGNDGQQEGEGEDTI

SEQ ID NO: 200210 - protein, 38 aa, Artificial Sequence
  Description of Artificial Sequence: Synthetic polypeptide
DEDEIATTNPVATEQYGSVCAMNNGNLEPPADIAEDAW

SEQ ID NO: 200211 - protein, 37 aa, Artificial Sequence
  Description of Artificial Sequence: Synthetic polypeptide
DQEEIATTNPVATEPYGTYCCQGNELSSVREVANNQY

SEQ ID NO: 200212 - protein, 35 aa, Artificial Sequence
  Description of Artificial Sequence: Synthetic polypeptide
DEDEISTTNPVAYERWGTVCSNDQHDQPGQGGGEI

SEQ ID NO: 200213 - protein, 36 aa, Artificial Sequence
  Description of Artificial Sequence: Synthetic polypeptide
MSNEIRTTNPVATEQYGSCVWVEADIVETTAMPVPQ

SEQ ID NO: 200214 - protein, 37 aa, Artificial Sequence
  Description of Artificial Sequence: Synthetic polypeptide
AEEEIATTNPVATEQYGCSCPNWGEDNQEYFISENQA

SEQ ID NO: 200215 - protein, 36 aa, Artificial Sequence
  Description of Artificial Sequence: Synthetic polypeptide
AEAEIATTNPVATCQYGCVCSWGAHNQENFNSDTQS

SEQ ID NO: 200216 - protein, 39 aa, Artificial Sequence
  Description of Artificial Sequence: Synthetic polypeptide
DEEEIRTTNPVATLQYGTVVARSFELANIIETSPAQNYE

SEQ ID NO: 200217 - protein, 38 aa, Artificial Sequence
  Description of Artificial Sequence: Synthetic polypeptide
CEGEIVTTNPVATEQYGSVTMGDSDQGGGQQDGEEDEV

SEQ ID NO: 200218 - protein, 38 aa, Artificial Sequence
  Description of Artificial Sequence: Synthetic polypeptide
AEEEIATTNPVATEQYGCSCPNSGEADNQEHFNSENQS

SEQ ID NO: 200219 - protein, 35 aa, Artificial Sequence
  Description of Artificial Sequence: Synthetic polypeptide
DEMAISTTNPVATEQYGCLCTATDGRPVEFETDKQ

SEQ ID NO: 200220 - protein, 37 aa, Artificial Sequence
  Description of Artificial Sequence: Synthetic polypeptide
DEAEIRTTNPVATEQYGMCWYNAVNHLSVLDSFEEQN

SEQ ID NO: 200221 - protein, 38 aa, Artificial Sequence
  Description of Artificial Sequence: Synthetic polypeptide
DENEIRTTNPVATEQYGQCVCSNWGEDHNEENFISDQA

SEQ ID NO: 200222 - protein, 36 aa, Artificial Sequence
  Description of Artificial Sequence: Synthetic polypeptide
QMGEIRATNPVATEQYGSCSVTAVEHCDEELFEEHV

SEQ ID NO: 200223 - protein, 36 aa, Artificial Sequence
  Description of Artificial Sequence: Synthetic polypeptide
MSNEIRTTNPVATEQYGACIHGTTLEDHNDEYGDEQ

SEQ ID NO: 200224 - protein, 36 aa, Artificial Sequence
  Description of Artificial Sequence: Synthetic polypeptide
CEACISTTNPVATEQYGCVCSSGEDHNQNFNSDTQS

SEQ ID NO: 200225 - protein, 37 aa, Artificial Sequence
  Description of Artificial Sequence: Synthetic polypeptide
SEEEIATTNPVATEQYGQCSCPTWGEDNAEHFSSEQA

SEQ ID NO: 200226 - protein, 38 aa, Artificial Sequence
  Description of Artificial Sequence: Synthetic polypeptide
DEEEISTTNPVAYEQYGQCVCSWGEDHNQESFNSDTQA

SEQ ID NO: 200227 - protein, 38 aa, Artificial Sequence
  Description of Artificial Sequence: Synthetic polypeptide
DEEEISTTNPVAYEQYGQCVCSWGEDHNQESSNSDNQS

SEQ ID NO: 200228 - protein, 31 aa, Artificial Sequence
  Description of Artificial Sequence: Synthetic polypeptide
DDSEVASTNPVSTEGWGATAAATIQSPVGQR

SEQ ID NO: 200229 - protein, 37 aa, Artificial Sequence
  Description of Artificial Sequence: Synthetic polypeptide
CEEEIACTNPVAYEQWGSVCSMANPQPQEHQDGTGMK

SEQ ID NO: 200230 - protein, 37 aa, Artificial Sequence
  Description of Artificial Sequence: Synthetic polypeptide
DEEEISTTNPVAYEQYGQCVCSWGEDHNQEYFSSEQS

SEQ ID NO: 200231 - protein, 36 aa, Artificial Sequence
  Description of Artificial Sequence: Synthetic polypeptide
DEDEISTTNPVATEPWGSVCLIEDIGDRDRNGGDDI

SEQ ID NO: 200232 - protein, 38 aa, Artificial Sequence
  Description of Artificial Sequence: Synthetic polypeptide
DEECISTTNPVATEQYGCVCSNWMEDHNAENFNSENQA

SEQ ID NO: 200233 - protein, 38 aa, Artificial Sequence
  Description of Artificial Sequence: Synthetic polypeptide
DDEEIRTTNPVATEFYGCVNVNMTGGQEENDGGGITTT

SEQ ID NO: 200234 - protein, 36 aa, Artificial Sequence
  Description of Artificial Sequence: Synthetic polypeptide
CEAEIACTNPVATEQWGCITAGTGLVQTAENAGMNV

SEQ ID NO: 200235 - protein, 37 aa, Artificial Sequence
  Description of Artificial Sequence: Synthetic polypeptide
CEEEISTTNPVATEGYGCVCSNWGEHNQENFGSDTQA

SEQ ID NO: 200236 - protein, 36 aa, Artificial Sequence
  Description of Artificial Sequence: Synthetic polypeptide
ENEEIATTNPVAYEQWGTYYMIQVNDQHEHGQNDRH

SEQ ID NO: 200237 - protein, 39 aa, Artificial Sequence
  Description of Artificial Sequence: Synthetic polypeptide
DEEEIRTTNPVATEAYGVVATVTTNQAGTEAGTVTDDED

SEQ ID NO: 200238 - protein, 37 aa, Artificial Sequence
  Description of Artificial Sequence: Synthetic polypeptide
DEECISTTNPVATEQYGCVCSNWGEHNQENFPSETQP

SEQ ID NO: 200239 - protein, 39 aa, Artificial Sequence
  Description of Artificial Sequence: Synthetic polypeptide
DEEEIRTTNPVATEAYGVVATVTTNQAGTEAGSVTEEEE

SEQ ID NO: 200240 - protein, 34 aa, Artificial Sequence
  Description of Artificial Sequence: Synthetic polypeptide
YETEIASTNPIATECWGAVWANAENLQESKGPYI

SEQ ID NO: 200241 - protein, 37 aa, Artificial Sequence
  Description of Artificial Sequence: Synthetic polypeptide
DEEEISTTNPVAYEQYGQCVCSWGEHNQENFISETQA

SEQ ID NO: 200242 - protein, 33 aa, Artificial Sequence
  Description of Artificial Sequence: Synthetic polypeptide
QESEIASTNPVGTEGWGVCAPTDNQQNHQGQDN

SEQ ID NO: 200243 - protein, 39 aa, Artificial Sequence
  Description of Artificial Sequence: Synthetic polypeptide
SEEEIRTTNPVATEGYGMVDNGQGTFNNQGNGGGEQFGE

SEQ ID NO: 200244 - protein, 39 aa, Artificial Sequence
  Description of Artificial Sequence: Synthetic polypeptide
SEEEIRTTNPVATEGYGMVDNGQGTNDDQEGPGGEQTGD

SEQ ID NO: 200245 - protein, 38 aa, Artificial Sequence
  Description of Artificial Sequence: Synthetic polypeptide
DEMEISTTNPVATEQYGCVCSNWGEDHNAENFNSDNQS

SEQ ID NO: 200246 - protein, 38 aa, Artificial Sequence
  Description of Artificial Sequence: Synthetic polypeptide
AEEEISTTNPVATEQYGCVCSNWGEDHNQEYFNSDTQS

SEQ ID NO: 200247 - protein, 39 aa, Artificial Sequence
  Description of Artificial Sequence: Synthetic polypeptide
DEEEIRTTNPVATLQYGTVAARSFEDANIIETSLAQNYE

SEQ ID NO: 200248 - protein, 38 aa, Artificial Sequence
  Description of Artificial Sequence: Synthetic polypeptide
DEEEISTTNPVAYEQYGCVCSNWGEEHNQENFNSDTQS

SEQ ID NO: 200249 - protein, 37 aa, Artificial Sequence
  Description of Artificial Sequence: Synthetic polypeptide
DEECIRTTNPVATEQYSACVCSWGEDDNQENFISDQA

SEQ ID NO: 200250 - protein, 37 aa, Artificial Sequence
  Description of Artificial Sequence: Synthetic polypeptide
DETEIACTNPVATEQYGSACSPVGPDQNDSGGDQMAH

SEQ ID NO: 200251 - protein, 38 aa, Artificial Sequence
  Description of Artificial Sequence: Synthetic polypeptide
DETEIACTNPVATEQYGSCAAAAINGVPLEAMEHGNHE

SEQ ID NO: 200252 - protein, 38 aa, Artificial Sequence
  Description of Artificial Sequence: Synthetic polypeptide
DEMEISTTNPVATEQYGCVCSNWGEDHNAEYFNSDNQS

SEQ ID NO: 200253 - protein, 40 aa, Artificial Sequence
  Description of Artificial Sequence: Synthetic polypeptide
DEEEIRTTNPVATLQYGTVAARSFELANIIEDTSGAQNTE

SEQ ID NO: 200254 - protein, 37 aa, Artificial Sequence
  Description of Artificial Sequence: Synthetic polypeptide
TEEEISTTNPVATEQYGCVCSNWVEHNQENFISDTQS

SEQ ID NO: 200255 - protein, 38 aa, Artificial Sequence
  Description of Artificial Sequence: Synthetic polypeptide
DDEEIHTTNPVATEFYGCVNINMTGLQEENDGGGETTT

SEQ ID NO: 200256 - protein, 40 aa, Artificial Sequence
  Description of Artificial Sequence: Synthetic polypeptide
DEEEIRTTNPVATLQYGTVAARSFELANIIEEMSGNQNYE

SEQ ID NO: 200257 - protein, 38 aa, Artificial Sequence
  Description of Artificial Sequence: Synthetic polypeptide
AEECISTTNPVATEQYGCVCSNWGEDHNAENFGSENQS

SEQ ID NO: 200258 - protein, 39 aa, Artificial Sequence
  Description of Artificial Sequence: Synthetic polypeptide
DEEEIRTTNPVATEQYGSCQIRPCSVEEYEEVIGTPVEL

SEQ ID NO: 200259 - protein, 38 aa, Artificial Sequence
  Description of Artificial Sequence: Synthetic polypeptide
TEEEISTTNPVATEQYGCVCQNWGEDDNQEYFGSDTQS

SEQ ID NO: 200260 - protein, 38 aa, Artificial Sequence
  Description of Artificial Sequence: Synthetic polypeptide
DEMEISTTNPVATEQYGCVCSNWGEDDNAEHFNSDTQS

SEQ ID NO: 200261 - protein, 38 aa, Artificial Sequence
  Description of Artificial Sequence: Synthetic polypeptide
DEECIRTTNPVATEQYSACVCSWGEDHNAEYFNSDTQS

SEQ ID NO: 200262 - protein, 38 aa, Artificial Sequence
  Description of Artificial Sequence: Synthetic polypeptide
DEEEISTTNPVAYEQYGCVCSNWGEDHNTENFFSETQA

SEQ ID NO: 200263 - protein, 35 aa, Artificial Sequence
  Description of Artificial Sequence: Synthetic polypeptide
QETEIRTTNPVATEQWGATTWANEEDWAEPKGPYI

SEQ ID NO: 200264 - protein, 39 aa, Artificial Sequence
  Description of Artificial Sequence: Synthetic polypeptide
DEEEIATTNPVAYEQYGSTVCAVAEAGGAQASGGDNMAG

SEQ ID NO: 200265 - protein, 38 aa, Artificial Sequence
  Description of Artificial Sequence: Synthetic polypeptide
DEEEISTTNPVAYEQYGCVCSNWGEDHNQENFGSDTQA

SEQ ID NO: 200266 - protein, 38 aa, Artificial Sequence
  Description of Artificial Sequence: Synthetic polypeptide
DEEEISTTNPVAYEQYGCVCSNWGEDHNQENFGSDTQE

SEQ ID NO: 200267 - protein, 38 aa, Artificial Sequence
  Description of Artificial Sequence: Synthetic polypeptide
DEEEISTTNPVAYEQYGCVCSNWGEDHNQENFGSDTQS

SEQ ID NO: 200268 - protein, 37 aa, Artificial Sequence
  Description of Artificial Sequence: Synthetic polypeptide
DETEIACTNPVATEQYGSCAAANQGVPLEAMEHGHHV

SEQ ID NO: 200269 - protein, 38 aa, Artificial Sequence
  Description of Artificial Sequence: Synthetic polypeptide
DEEEISTTNPVAYEQYGCVCSNWGEDHNQENFGSETQS

SEQ ID NO: 200270 - protein, 38 aa, Artificial Sequence
  Description of Artificial Sequence: Synthetic polypeptide
DEMEISTTNPVATEQYGCVCSNWEEDHNAENFNSDNQS

SEQ ID NO: 200271 - protein, 38 aa, Artificial Sequence
  Description of Artificial Sequence: Synthetic polypeptide
DEEEISTTNPVATEQWGICQVCSYWGEDHNANFGSQQA

SEQ ID NO: 200272 - protein, 38 aa, Artificial Sequence
  Description of Artificial Sequence: Synthetic polypeptide
AEEEISTTNPVATEQYGCVCSNWGEDHNQENFNSDTQS

SEQ ID NO: 200273 - protein, 39 aa, Artificial Sequence
  Description of Artificial Sequence: Synthetic polypeptide
DDEEIRTTNPVATEFYGQVNFNMDLQLVDQGGGGQDQGD

SEQ ID NO: 200274 - protein, 38 aa, Artificial Sequence
  Description of Artificial Sequence: Synthetic polypeptide
DEEEISTTNPVAYEQYGCVCSNWGEDHNQENFNSDNQA

SEQ ID NO: 200275 - protein, 38 aa, Artificial Sequence
  Description of Artificial Sequence: Synthetic polypeptide
DEEEISTTNPVAYEQYGCVCSNWGEDHNQENFNSENQS

SEQ ID NO: 200276 - protein, 38 aa, Artificial Sequence
  Description of Artificial Sequence: Synthetic polypeptide
DEEEISTTNPVAYEQYGCVCSNWGEDHNQEYFNSDTQS

SEQ ID NO: 200277 - protein, 38 aa, Artificial Sequence
  Description of Artificial Sequence: Synthetic polypeptide
DEEEISTTNPVAYEQYGCVCSNWGEDHNTENFFSDTQD

SEQ ID NO: 200278 - protein, 38 aa, Artificial Sequence
  Description of Artificial Sequence: Synthetic polypeptide
TEEEISTTNPVATEQYGQCVCNNWGEDNQEYFGSDTQA

SEQ ID NO: 200279 - protein, 38 aa, Artificial Sequence
  Description of Artificial Sequence: Synthetic polypeptide
TEEEISTTNPVATEQYGQCVCSNWMEHNQENFISDNQS

SEQ ID NO: 200280 - protein, 38 aa, Artificial Sequence
  Description of Artificial Sequence: Synthetic polypeptide
DEDEIRTTNPVAYEQWGVACYTGDNLHNDQDTQGQTDV

SEQ ID NO: 200281 - protein, 38 aa, Artificial Sequence
  Description of Artificial Sequence: Synthetic polypeptide
DETEIACTNPVATEQYGSACSPTGEGGVGAMNEDQTNH

SEQ ID NO: 200282 - protein, 38 aa, Artificial Sequence
  Description of Artificial Sequence: Synthetic polypeptide
DETEIACTNPVATEQYGSACSPANDTSTLNDAEEGKME

SEQ ID NO: 200283 - protein, 38 aa, Artificial Sequence
  Description of Artificial Sequence: Synthetic polypeptide
DEDEIRTTNPVAYEQWGVACYTGDNLKNDQNTQGQDDI

SEQ ID NO: 200284 - protein, 38 aa, Artificial Sequence
  Description of Artificial Sequence: Synthetic polypeptide
DEMEISTTNPVATEQYGCVCSNWGEDHNQENFNSDTQS

SEQ ID NO: 200285 - protein, 37 aa, Artificial Sequence
  Description of Artificial Sequence: Synthetic polypeptide
DEEEIACTNPVATEQWGGCNVAGTAGQDDNQMGGEDH

SEQ ID NO: 200286 - protein, 34 aa, Artificial Sequence
  Description of Artificial Sequence: Synthetic polypeptide
CETEIACTNPVATEQWGCVAGTEGHEAGPGEEDH

SEQ ID NO: 200287 - protein, 38 aa, Artificial Sequence
  Description of Artificial Sequence: Synthetic polypeptide
DEDEIRTTNPVAYEQWGVACYTGDVLENDQHTQGQDDD

SEQ ID NO: 200288 - protein, 37 aa, Artificial Sequence
  Description of Artificial Sequence: Synthetic polypeptide
DEEEISTTNPVATEPYGTYPCQGNEHSSDRYVTNNQY

SEQ ID NO: 200289 - protein, 38 aa, Artificial Sequence
  Description of Artificial Sequence: Synthetic polypeptide
DEEEIRTTNPVATEQYGSTCEMWIEYQHSEMQEAVCVD

SEQ ID NO: 200290 - protein, 38 aa, Artificial Sequence
  Description of Artificial Sequence: Synthetic polypeptide
DEDEIRTTNPVAYEQWGVACYTNDELHNDQNAQGGDDD

SEQ ID NO: 200291 - protein, 39 aa, Artificial Sequence
  Description of Artificial Sequence: Synthetic polypeptide
DEDEIRTTNPVAYEQWGVACYTNDELHNDQNTQGQDDDR

SEQ ID NO: 200292 - protein, 38 aa, Artificial Sequence
  Description of Artificial Sequence: Synthetic polypeptide
DEDEIRTTNPVAYEQWGVACYTNDNLINDQNTQGQDDD

SEQ ID NO: 200293 - protein, 38 aa, Artificial Sequence
  Description of Artificial Sequence: Synthetic polypeptide
DEMEISTTNPVATEQYGCVCSNWGEDPNAENFQSDTQA

SEQ ID NO: 200294 - protein, 37 aa, Artificial Sequence
  Description of Artificial Sequence: Synthetic polypeptide
DEEEISTTNPVATEPYGTYACQGNEASSVRFVTNNQE

SEQ ID NO: 200295 - protein, 38 aa, Artificial Sequence
  Description of Artificial Sequence: Synthetic polypeptide
DEEEISTTNPVAYEQYGCVCSNWMEDHNAENFNSDNQA

SEQ ID NO: 200296 - protein, 37 aa, Artificial Sequence
  Description of Artificial Sequence: Synthetic polypeptide
DEEEISTTNPVATEPYGTYACQGAELSSVRPVLNNQY

SEQ ID NO: 200297 - protein, 37 aa, Artificial Sequence
  Description of Artificial Sequence: Synthetic polypeptide
QEEEIRTTNPVATDFYGSVYDNGGTGDIEGEDEIEQL

SEQ ID NO: 200298 - protein, 39 aa, Artificial Sequence
  Description of Artificial Sequence: Synthetic polypeptide
DEEEIRTTNPVATLQYGTVAARPFELANGIETSGAQNYE

SEQ ID NO: 200299 - protein, 38 aa, Artificial Sequence
  Description of Artificial Sequence: Synthetic polypeptide
DEDEIRTTNPVAYEQWGVACYTGDNLHRDQNTQGQDDM

SEQ ID NO: 200300 - protein, 38 aa, Artificial Sequence
  Description of Artificial Sequence: Synthetic polypeptide
DEETICTTNPVATEFYGVVVTNETDNTGEFDEFGGNIQ

SEQ ID NO: 200301 - protein, 38 aa, Artificial Sequence
  Description of Artificial Sequence: Synthetic polypeptide
DEDEIRTTNPVAYEQWGVACYTGDNLHNDQKTQGQDED

SEQ ID NO: 200302 - protein, 38 aa, Artificial Sequence
  Description of Artificial Sequence: Synthetic polypeptide
DEDEIRTTNPVAYEQWGVACYTGDNLHNDQMTKGQSDD

SEQ ID NO: 200303 - protein, 38 aa, Artificial Sequence
  Description of Artificial Sequence: Synthetic polypeptide
DEEEISTTNPVATEQWGCVCSNWGEDHNAENFNSETQS

SEQ ID NO: 200304 - protein, 39 aa, Artificial Sequence
  Description of Artificial Sequence: Synthetic polypeptide
DEEEIRTTNPVATEQYGQCYCSNWNEDHNAENFISDTQA

SEQ ID NO: 200305 - protein, 40 aa, Artificial Sequence
  Description of Artificial Sequence: Synthetic polypeptide
DEEEIRTTNPVATEQYGDMAAISPTATPLHVVTPMQNETN

SEQ ID NO: 200306 - protein, 40 aa, Artificial Sequence
  Description of Artificial Sequence: Synthetic polypeptide
DEEEIRTTNPVATLQYGTVAARSFELANIIEETCGAQNIE

SEQ ID NO: 200307 - protein, 38 aa, Artificial Sequence
  Description of Artificial Sequence: Synthetic polypeptide
DEDEIRTTNPVAYEQWGVACYTGDNLHNDQNPQGQDDL

SEQ ID NO: 200308 - protein, 35 aa, Artificial Sequence
  Description of Artificial Sequence: Synthetic polypeptide
QAEEIATTNPVATASWGCNVAGAGLQTAGGDNDFM

SEQ ID NO: 200309 - protein, 35 aa, Artificial Sequence
  Description of Artificial Sequence: Synthetic polypeptide
DDSEVACTNPVSTEGYGNVCYNTIDQSRHGMDGSR

SEQ ID NO: 200310 - protein, 32 aa, Artificial Sequence
  Description of Artificial Sequence: Synthetic polypeptide
QEEEIATTNPVATECWGATAAEEDWAEPKEPI

SEQ ID NO: 200311 - protein, 40 aa, Artificial Sequence
  Description of Artificial Sequence: Synthetic polypeptide
DEEEIRTTNPVATEQYGDTACISPTATPVHVVSPFQNERN

SEQ ID NO: 200312 - protein, 39 aa, Artificial Sequence
  Description of Artificial Sequence: Synthetic polypeptide
DEEEIRTTNPVATEQYGDTVTGPAYNCYPEMAQSQDSTP

SEQ ID NO: 200313 - protein, 38 aa, Artificial Sequence
  Description of Artificial Sequence: Synthetic polypeptide
TEEEISTTNPVAYECYGTVQACTGYEGQQNKLQGGQIE

SEQ ID NO: 200314 - protein, 39 aa, Artificial Sequence
  Description of Artificial Sequence: Synthetic polypeptide
DEDEIRTTNPVAYEQWGVACYTGDNLHNDQRTQGQDDDK

SEQ ID NO: 200315 - protein, 38 aa, Artificial Sequence
  Description of Artificial Sequence: Synthetic polypeptide
DEEEIRCTNPVATEEYGQCVCSMWGEHNQENFNSENQS

SEQ ID NO: 200316 - protein, 39 aa, Artificial Sequence
  Description of Artificial Sequence: Synthetic polypeptide
DEECISTTNPVATEQYGQCVCSNWGEDHNAEHFGSENQS

SEQ ID NO: 200317 - protein, 34 aa, Artificial Sequence
  Description of Artificial Sequence: Synthetic polypeptide
QETEIRTTNPVATECWGVTWANAEDWAEHKGDYI

SEQ ID NO: 200318 - protein, 32 aa, Artificial Sequence
  Description of Artificial Sequence: Synthetic polypeptide
QETEIRTTNPVATECWGATANAECWAHKEPYI

SEQ ID NO: 200319 - protein, 38 aa, Artificial Sequence
  Description of Artificial Sequence: Synthetic polypeptide
AEEEISTTNPVATEQYGCVCSNWGEDHNQENFNSDNQS

SEQ ID NO: 200320 - protein, 39 aa, Artificial Sequence
  Description of Artificial Sequence: Synthetic polypeptide
DEEEISTTNPVATEQYGCAVCSNWGEDHNAEGFNSDNQA

SEQ ID NO: 200321 - protein, 38 aa, Artificial Sequence
  Description of Artificial Sequence: Synthetic polypeptide
DEEEISTTNPVAYEQYGCVCSNWGEDDNAENFGSDTQS

SEQ ID NO: 200322 - protein, 38 aa, Artificial Sequence
  Description of Artificial Sequence: Synthetic polypeptide
DEEEISTTNPVAYEQYGCVCSNWGEDDNAENFNSDNQS

SEQ ID NO: 200323 - protein, 38 aa, Artificial Sequence
  Description of Artificial Sequence: Synthetic polypeptide
AEEEISTTNPVATEQYGCVCSNWGEDHNAENFNSETQS

SEQ ID NO: 200324 - protein, 38 aa, Artificial Sequence
  Description of Artificial Sequence: Synthetic polypeptide
AEEEISTTNPVATEQYGCVCSNWGEDHNAENFNSQTQA

SEQ ID NO: 200325 - protein, 38 aa, Artificial Sequence
  Description of Artificial Sequence: Synthetic polypeptide
DEEEISTTNPVAYEQYGCVCSNWGEDDNEENFNSDTQA

SEQ ID NO: 200326 - protein, 38 aa, Artificial Sequence
  Description of Artificial Sequence: Synthetic polypeptide
MESEIRTTNPVATEQYGMVSVPNTDAGEPQPIPQEEPQ

SEQ ID NO: 200327 - protein, 39 aa, Artificial Sequence
  Description of Artificial Sequence: Synthetic polypeptide
DEEEISTTNPVATEQYGCAVCSMWGEDHNAENFNSDTQL

SEQ ID NO: 200328 - protein, 38 aa, Artificial Sequence
  Description of Artificial Sequence: Synthetic polypeptide
DEEEISTTNPVAYEQYGCVCSNWGEDDNIENFNSETQS

SEQ ID NO: 200329 - protein, 38 aa, Artificial Sequence
  Description of Artificial Sequence: Synthetic polypeptide
DEEEISTTNPVATEQYGCAVCSMSGEHNAENFPSETQA

SEQ ID NO: 200330 - protein, 34 aa, Artificial Sequence
  Description of Artificial Sequence: Synthetic polypeptide
DDSEVACTNPVSTEGYGNVCYNTIDQSRHEMQRG

SEQ ID NO: 200331 - protein, 38 aa, Artificial Sequence
  Description of Artificial Sequence: Synthetic polypeptide
DEMEISTTNPVATEQYGCVCSNSGEDDNAENFNSDNQS

SEQ ID NO: 200332 - protein, 34 aa, Artificial Sequence
  Description of Artificial Sequence: Synthetic polypeptide
QETEIRTTNPIATECWGATTWANAEDLAEHKGPI

SEQ ID NO: 200333 - protein, 39 aa, Artificial Sequence
  Description of Artificial Sequence: Synthetic polypeptide
CEEEIRTTNPVAYEQYGQCVCSNWGEDTNQENFISDNQS

SEQ ID NO: 200334 - protein, 34 aa, Artificial Sequence
  Description of Artificial Sequence: Synthetic polypeptide
QETEIRTTNPIATECWGATTWANAEDLAEHKGPL

SEQ ID NO: 200335 - protein, 38 aa, Artificial Sequence
  Description of Artificial Sequence: Synthetic polypeptide
DEDEIATTNPVAYEQYGSVCSADNPPGDNAHPDDNEAM

SEQ ID NO: 200336 - protein, 39 aa, Artificial Sequence
  Description of Artificial Sequence: Synthetic polypeptide
SEEEIRTTNPVATEQYGQCVCSNWGEDHNAEHFNSDTQA

SEQ ID NO: 200337 - protein, 38 aa, Artificial Sequence
  Description of Artificial Sequence: Synthetic polypeptide
AEEEISTTNPVATEQYGCVCSNWGEDHNAENFNSDTQI

SEQ ID NO: 200338 - protein, 38 aa, Artificial Sequence
  Description of Artificial Sequence: Synthetic polypeptide
DETEIACTNPVATEQYGSCAAVGGHVLTGPDDGMGDNH

SEQ ID NO: 200339 - protein, 38 aa, Artificial Sequence
  Description of Artificial Sequence: Synthetic polypeptide
QEEEIRTTNPVATESYGTVMNPTTPEGPEMGQGENEEG

SEQ ID NO: 200340 - protein, 37 aa, Artificial Sequence
  Description of Artificial Sequence: Synthetic polypeptide
DEMEISTTNPVATEQYGCICSTWGETNQENFISDTQS

SEQ ID NO: 200341 - protein, 38 aa, Artificial Sequence
  Description of Artificial Sequence: Synthetic polypeptide
MESEIRTTNPVATEQYGAVSVPNTDAHEPQPITQEEPQ

SEQ ID NO: 200342 - protein, 38 aa, Artificial Sequence
  Description of Artificial Sequence: Synthetic polypeptide
DEYEISTTNPVATEFYGVIVSATGDQGQEDQEGGEDGD

SEQ ID NO: 200343 - protein, 36 aa, Artificial Sequence
  Description of Artificial Sequence: Synthetic polypeptide
EIEEIATTNPVAYEQWGSCVTWFTPEGDQKKGRTDK

SEQ ID NO: 200344 - protein, 38 aa, Artificial Sequence
  Description of Artificial Sequence: Synthetic polypeptide
DEEEISTTNPVAYEQYGCVCSNWEEDDNAENFNSDNQS

SEQ ID NO: 200345 - protein, 38 aa, Artificial Sequence
  Description of Artificial Sequence: Synthetic polypeptide
DEEEISTTNPVAYEQYGCVCSNWEEDDNTENFNSDTQS

SEQ ID NO: 200346 - protein, 38 aa, Artificial Sequence
  Description of Artificial Sequence: Synthetic polypeptide
DENEISTTNPVATEQYGQCVCSNWGEHNAENFSSDNQS

SEQ ID NO: 200347 - protein, 38 aa, Artificial Sequence
  Description of Artificial Sequence: Synthetic polypeptide
DEEEISTTNPVAYEQYGCVCSNWEEDHNAENFGSDTQS

SEQ ID NO: 200348 - protein, 38 aa, Artificial Sequence
  Description of Artificial Sequence: Synthetic polypeptide
DEEEISTTNPVAYEQYGCVCSNWEEDHNAESFNSDTQA

SEQ ID NO: 200349 - protein, 38 aa, Artificial Sequence
  Description of Artificial Sequence: Synthetic polypeptide
DEEEISTTNPVAYEQYGCVCSNWEEDHNTENFISDTQS

SEQ ID NO: 200350 - protein, 37 aa, Artificial Sequence
  Description of Artificial Sequence: Synthetic polypeptide
DDEEISTTNPVATCQYGQCVCSWGEDNAENFGSDTQA

SEQ ID NO: 200351 - protein, 38 aa, Artificial Sequence
  Description of Artificial Sequence: Synthetic polypeptide
DEEEISTTNPVAYEQYGCVCSNWEEEHNAENFNSDTQA

SEQ ID NO: 200352 - protein, 38 aa, Artificial Sequence
  Description of Artificial Sequence: Synthetic polypeptide
AEEEISTTNPVATEQYGCVCSNWGEDHNAENFISDNQL

SEQ ID NO: 200353 - protein, 38 aa, Artificial Sequence
  Description of Artificial Sequence: Synthetic polypeptide
AEEEISTTNPVATEQYGCVCSNWGEDHNAENFNSDTQA

SEQ ID NO: 200354 - protein, 39 aa, Artificial Sequence
  Description of Artificial Sequence: Synthetic polypeptide
DEEEISTTNPVATEQYGCAVCSNWGEDHNAENFNSDNQS

SEQ ID NO: 200355 - protein, 34 aa, Artificial Sequence
  Description of Artificial Sequence: Synthetic polypeptide
DDSEVACTNPVSTEGYGNVCYNTIDQSRHGMQES

SEQ ID NO: 200356 - protein, 39 aa, Artificial Sequence
  Description of Artificial Sequence: Synthetic polypeptide
SEEEIRTTNPVATEQYGQCVCSNWEEDHNAENFNSDNQG

SEQ ID NO: 200357 - protein, 39 aa, Artificial Sequence
  Description of Artificial Sequence: Synthetic polypeptide
SEEEIRTTNPVATEQYGQCVCGTWGADHNQENFGSDTQA

SEQ ID NO: 200358 - protein, 37 aa, Artificial Sequence
  Description of Artificial Sequence: Synthetic polypeptide
CEEEIACTNPVATEQYGSACSAGDPIGINHGDENGHH

SEQ ID NO: 200359 - protein, 37 aa, Artificial Sequence
  Description of Artificial Sequence: Synthetic polypeptide
DEEEIATTNPVAYEQYGSTACAGVANAEATTGGDQSL

SEQ ID NO: 200360 - protein, 38 aa, Artificial Sequence
  Description of Artificial Sequence: Synthetic polypeptide
DEEEISTTNPVAYEQYGCVCSNWGEDHNAEHFNSDTQS

SEQ ID NO: 200361 - protein, 38 aa, Artificial Sequence
  Description of Artificial Sequence: Synthetic polypeptide
DEEEISTTNPVAYEQYGCVCSNWGEDHNAENFISDNQG

SEQ ID NO: 200362 - protein, 36 aa, Artificial Sequence
  Description of Artificial Sequence: Synthetic polypeptide
DETEIACTNPVATEQYGSCAAGDGIGNNHADETNTW

SEQ ID NO: 200363 - protein, 36 aa, Artificial Sequence
  Description of Artificial Sequence: Synthetic polypeptide
DETEIACTNPVATEQYGSCAAGDGIGNNHADEMNDA

SEQ ID NO: 200364 - protein, 38 aa, Artificial Sequence
  Description of Artificial Sequence: Synthetic polypeptide
DEEEISTTNPVAYEQYGCVCSNWGEDHNAENFNSDNQA

SEQ ID NO: 200365 - protein, 38 aa, Artificial Sequence
  Description of Artificial Sequence: Synthetic polypeptide
DEEEISTTNPVAYEQYGCVCSNWGEDHNAENFNSDTQA

SEQ ID NO: 200366 - protein, 38 aa, Artificial Sequence
  Description of Artificial Sequence: Synthetic polypeptide
DEEEISTTNPVAYEQYGCVCSNWGEDHNAENSNSENQS

SEQ ID NO: 200367 - protein, 38 aa, Artificial Sequence
  Description of Artificial Sequence: Synthetic polypeptide
DEEEISTTNPVAYEQYGCVCSNWGEDHNEENFNSDTQS

SEQ ID NO: 200368 - protein, 38 aa, Artificial Sequence
  Description of Artificial Sequence: Synthetic polypeptide
DEEEISTTNPVATEQWGQCVCSMSGEHNAENFNSDTQA

SEQ ID NO: 200369 - protein, 38 aa, Artificial Sequence
  Description of Artificial Sequence: Synthetic polypeptide
DEEEISTTNPVAYEQYGCVCSNWGEDHNIENFGSETQA

SEQ ID NO: 200370 - protein, 38 aa, Artificial Sequence
  Description of Artificial Sequence: Synthetic polypeptide
DEEEISTTNPVAYEQYGCVCSNWGEDHNIENFNSDNQA

SEQ ID NO: 200371 - protein, 38 aa, Artificial Sequence
  Description of Artificial Sequence: Synthetic polypeptide
DEEEISTTNPVAYEQYGCVCSNWGEDHNQEFFISDNQA

SEQ ID NO: 200372 - protein, 37 aa, Artificial Sequence
  Description of Artificial Sequence: Synthetic polypeptide
DETEIACTNPVATEQYGSCAAATHGPEAGMPMGETNY

SEQ ID NO: 200373 - protein, 38 aa, Artificial Sequence
  Description of Artificial Sequence: Synthetic polypeptide
AEEEISTTNPVATEQYGCVCSNWGEDHNQENFGSDTQS

SEQ ID NO: 200374 - protein, 36 aa, Artificial Sequence
  Description of Artificial Sequence: Synthetic polypeptide
EIEEIATTNPVAYEQWGSCVTWPPERGDQKHGRTDK

SEQ ID NO: 200375 - protein, 38 aa, Artificial Sequence
  Description of Artificial Sequence: Synthetic polypeptide
AEEEISTTNPVATEQYGCVCSNWGEDHNQENFGSDTQA

SEQ ID NO: 200376 - protein, 38 aa, Artificial Sequence
  Description of Artificial Sequence: Synthetic polypeptide
AEEEISTTNPVATEQYGCVCSNWGEDHNQEFFGSDTQS

SEQ ID NO: 200377 - protein, 38 aa, Artificial Sequence
  Description of Artificial Sequence: Synthetic polypeptide
DEEEISTTNPVAYEQYGCVCSNWGEDHEQENFGSETQN

SEQ ID NO: 200378 - protein, 38 aa, Artificial Sequence
  Description of Artificial Sequence: Synthetic polypeptide
CEEEIRTTNPVAYEQYGQCVCSNWGEHEQENFNSDNQS

SEQ ID NO: 200379 - protein, 38 aa, Artificial Sequence
  Description of Artificial Sequence: Synthetic polypeptide
SEEEIRTTNPVATEQYGQCVCGNWMAHNAENFISDNQS

SEQ ID NO: 200380 - protein, 34 aa, Artificial Sequence
  Description of Artificial Sequence: Synthetic polypeptide
VETEIACTNPVATEQWGGCVAGNVGELITNMMAG

SEQ ID NO: 200381 - protein, 37 aa, Artificial Sequence
  Description of Artificial Sequence: Synthetic polypeptide
DEECIRTTNPVATEQYYACVCSWGEHNIENFSSDTQA

SEQ ID NO: 200382 - protein, 38 aa, Artificial Sequence
  Description of Artificial Sequence: Synthetic polypeptide
DEEEISTTNPVATEQWGQCVCSNWGEHNAENFNSDTQL

SEQ ID NO: 200383 - protein, 38 aa, Artificial Sequence
  Description of Artificial Sequence: Synthetic polypeptide
SEEEIRTTNPVATEQYGMVSVEGMGDGGQGQEQIEAGE

SEQ ID NO: 200384 - protein, 34 aa, Artificial Sequence
  Description of Artificial Sequence: Synthetic polypeptide
QETEIRTTNPIATECWGATTWANAEDWQEPKGPI

SEQ ID NO: 200385 - protein, 38 aa, Artificial Sequence
  Description of Artificial Sequence: Synthetic polypeptide
SEEEIRTTNPVATEQYGMVSVEGMGDGGQGQEAFETGT

SEQ ID NO: 200386 - protein, 36 aa, Artificial Sequence
  Description of Artificial Sequence: Synthetic polypeptide
EIEEIATTNPVAYEQWGSCVTWTPQGDQKHGRTDKY

SEQ ID NO: 200387 - protein, 38 aa, Artificial Sequence
  Description of Artificial Sequence: Synthetic polypeptide
DEEEISTTNPVAYEQYGCVCSNWGEDHNAEFFNSDTQS

SEQ ID NO: 200388 - protein, 38 aa, Artificial Sequence
  Description of Artificial Sequence: Synthetic polypeptide
AEEEISTTNPVATEQYGCVCSNWGEDHNAESFNSDNQA

SEQ ID NO: 200389 - protein, 38 aa, Artificial Sequence
  Description of Artificial Sequence: Synthetic polypeptide
DEEEISTTNPVAYEQYGCVCSNWGEDHNAEGFISENQA

SEQ ID NO: 200390 - protein, 36 aa, Artificial Sequence
  Description of Artificial Sequence: Synthetic polypeptide
DETEIACTNPVATEQYGSCAAGDPIGNNHADDMNSW

SEQ ID NO: 200391 - protein, 35 aa, Artificial Sequence
  Description of Artificial Sequence: Synthetic polypeptide
EIEEIATTNPVAYEQWGTCVTWTPEGDQKHGRTDL

SEQ ID NO: 200392 - protein, 39 aa, Artificial Sequence
  Description of Artificial Sequence: Synthetic polypeptide
DEEEISTTNPVATEQWGQCVCSNWGEDHNAENFGSDNQS

SEQ ID NO: 200393 - protein, 39 aa, Artificial Sequence
  Description of Artificial Sequence: Synthetic polypeptide
SEEEIRTTNPVATEGYGMVDNGQGTNDDQAGEGGEQFGD

SEQ ID NO: 200394 - protein, 39 aa, Artificial Sequence
  Description of Artificial Sequence: Synthetic polypeptide
DEECISTTNPVATEQYGQCVCSNWEEPHNTENFNSDNQS

SEQ ID NO: 200395 - protein, 35 aa, Artificial Sequence
  Description of Artificial Sequence: Synthetic polypeptide
VESEIRTTNPVSTEPWGCIAPTDGQQQQQERGTES

SEQ ID NO: 200396 - protein, 38 aa, Artificial Sequence
  Description of Artificial Sequence: Synthetic polypeptide
DEEEISTTNPVATEGYGQCVCSNWGEDNAENFNSDNQS

SEQ ID NO: 200397 - protein, 39 aa, Artificial Sequence
  Description of Artificial Sequence: Synthetic polypeptide
DEEEISTTNPVAYEQYGQCQVCSNWGEHNTENFISDNQA

SEQ ID NO: 200398 - protein, 39 aa, Artificial Sequence
  Description of Artificial Sequence: Synthetic polypeptide
DEEEISTTNPVATEGYGQCVCSNWGEDHNQENFGSENQS

SEQ ID NO: 200399 - protein, 39 aa, Artificial Sequence
  Description of Artificial Sequence: Synthetic polypeptide
DEEEISTTNPVATEGYGQCVCSNWGEDHNQENFGSDNQI

SEQ ID NO: 200400 - protein, 39 aa, Artificial Sequence
  Description of Artificial Sequence: Synthetic polypeptide
DEEEISTTNPVATEGYGQCVCSNWGEDHNQENFGSDNQA

SEQ ID NO: 200401 - protein, 38 aa, Artificial Sequence
  Description of Artificial Sequence: Synthetic polypeptide
DEEEISTTNPVAYEQYGQCVCGMSGEHNAENFNSDTQS

SEQ ID NO: 200402 - protein, 38 aa, Artificial Sequence
  Description of Artificial Sequence: Synthetic polypeptide
DEEEISTTNPVATEGYGQCVCSNWGEDNIENFNSEFQG

SEQ ID NO: 200403 - protein, 38 aa, Artificial Sequence
  Description of Artificial Sequence: Synthetic polypeptide
CEGEIKTTNPVATEQYGSVTMGDQTDQGGGQDGEEVEV

SEQ ID NO: 200404 - protein, 39 aa, Artificial Sequence
  Description of Artificial Sequence: Synthetic polypeptide
DEAEIRTTNPVATEQYGTFIYEGTEVPDSSMVATGSQRF

SEQ ID NO: 200405 - protein, 39 aa, Artificial Sequence
  Description of Artificial Sequence: Synthetic polypeptide
SEEEIRTTNPVATEGYGTVDNGQGTNDDQEGGEGEQFGD

SEQ ID NO: 200406 - protein, 37 aa, Artificial Sequence
  Description of Artificial Sequence: Synthetic polypeptide
DETEIACTNPVATEQYGSACSAGDAIIQPDDLMGDQH

SEQ ID NO: 200407 - protein, 39 aa, Artificial Sequence
  Description of Artificial Sequence: Synthetic polypeptide
DEEEISTTNPVATEGYGQCVCSNWGEDHNAENFGSDNQG

SEQ ID NO: 200408 - protein, 39 aa, Artificial Sequence
  Description of Artificial Sequence: Synthetic polypeptide
QEVEIKTTNPVATEQYGSVVVGGGTEDGQQLGEGQGAND

SEQ ID NO: 200409 - protein, 39 aa, Artificial Sequence
  Description of Artificial Sequence: Synthetic polypeptide
DEEEISTTNPVATEGYGQCVCSNWGEDHNAENFGSDNQA

SEQ ID NO: 200410 - protein, 37 aa, Artificial Sequence
  Description of Artificial Sequence: Synthetic polypeptide
DEEEISTTNPVAYEQYGQCVCGWGEDNQEYFDSDNQS

SEQ ID NO: 200411 - protein, 35 aa, Artificial Sequence
  Description of Artificial Sequence: Synthetic polypeptide
DESEIRTTNPCSTEPWGCIAPIDLQQQQQQQGTNS

SEQ ID NO: 200412 - protein, 38 aa, Artificial Sequence
  Description of Artificial Sequence: Synthetic polypeptide
DEEEISTTNPVATEGYGQCVCSNWGEDNQENFNSDNQA

SEQ ID NO: 200413 - protein, 38 aa, Artificial Sequence
  Description of Artificial Sequence: Synthetic polypeptide
DEEEISTTNPVATEGYGQCVCSNWGEDNQENFNSDNQS

SEQ ID NO: 200414 - protein, 38 aa, Artificial Sequence
  Description of Artificial Sequence: Synthetic polypeptide
DEEEISTTNPVATEGYGQCVCSNWGEHNIENFNSDTQM

SEQ ID NO: 200415 - protein, 38 aa, Artificial Sequence
  Description of Artificial Sequence: Synthetic polypeptide
DEEEISTTNPVATEGYGQCVCSNWGEHNAENFNSQTQA

SEQ ID NO: 200416 - protein, 38 aa, Artificial Sequence
  Description of Artificial Sequence: Synthetic polypeptide
QEVEIGTTNPVATEQYGVVVVSGTDGGDEEEEGGNNAN

SEQ ID NO: 200417 - protein, 38 aa, Artificial Sequence
  Description of Artificial Sequence: Synthetic polypeptide
DEEEISTTNPVATEGYGQCVCSNWGEHNAENFNSDTQS

SEQ ID NO: 200418 - protein, 38 aa, Artificial Sequence
  Description of Artificial Sequence: Synthetic polypeptide
DEEEISTTNPVAYEQYGCVTSTWGADDNAEHFISDPQA

SEQ ID NO: 200419 - protein, 38 aa, Artificial Sequence
  Description of Artificial Sequence: Synthetic polypeptide
QEVEIGTTNPVATEQYGVVVVSGTQGGDEEEEGGNNGI

SEQ ID NO: 200420 - protein, 38 aa, Artificial Sequence
  Description of Artificial Sequence: Synthetic polypeptide
DEEEISTTNPVATEGYGQCVCSNWGEHNAENFNSDTQD

SEQ ID NO: 200421 - protein, 38 aa, Artificial Sequence
  Description of Artificial Sequence: Synthetic polypeptide
DEEEISTTNPVAYEQYGCVVCSNSGEHNEENFNSDTQL

SEQ ID NO: 200422 - protein, 38 aa, Artificial Sequence
  Description of Artificial Sequence: Synthetic polypeptide
DEEEISTTNPVATEGYGQCVCSNWGEHNAENFNSDTQA

SEQ ID NO: 200423 - protein, 38 aa, Artificial Sequence
  Description of Artificial Sequence: Synthetic polypeptide
DEEEISTTNPVATEGYGQCVCSNWGEHNAENFISENQS

SEQ ID NO: 200424 - protein, 38 aa, Artificial Sequence
  Description of Artificial Sequence: Synthetic polypeptide
DEEEISTTNPVATEGYGQCVCSNWGEHNAEHFNSDTQS

SEQ ID NO: 200425 - protein, 38 aa, Artificial Sequence
  Description of Artificial Sequence: Synthetic polypeptide
DEEEISTTNPVATEGYGQCVCSNWGEHNAEFFNSDTQS

SEQ ID NO: 200426 - protein, 39 aa, Artificial Sequence
  Description of Artificial Sequence: Synthetic polypeptide
DEEEISTTNPVAYEQYGQCQVCGNSGEDNTENFNSENQA

SEQ ID NO: 200427 - protein, 34 aa, Artificial Sequence
  Description of Artificial Sequence: Synthetic polypeptide
TEDEIASVNPVCYEPYGVTVNTINWSQAAGGANV

SEQ ID NO: 200428 - protein, 39 aa, Artificial Sequence
  Description of Artificial Sequence: Synthetic polypeptide
DEEEISTTNPVATEGYGQCVCSNWGEDTNAENFNSDNQA

SEQ ID NO: 200429 - protein, 38 aa, Artificial Sequence
  Description of Artificial Sequence: Synthetic polypeptide
QEVEIQTTNPVATEQYGVVVQSGTDGGDEEEEGGNNDI

SEQ ID NO: 200430 - protein, 38 aa, Artificial Sequence
  Description of Artificial Sequence: Synthetic polypeptide
DEEEISTTNPVAYEQYGQCVCSDWGEHNTEYFNSDNQS

SEQ ID NO: 200431 - protein, 38 aa, Artificial Sequence
  Description of Artificial Sequence: Synthetic polypeptide
DEEEISTTNPVAYEQYGQCVCSMSGEHNQESFISDNQP

SEQ ID NO: 200432 - protein, 38 aa, Artificial Sequence
  Description of Artificial Sequence: Synthetic polypeptide
SEEEIRTTNPVATEGYGQCVCSNWEEHNAEYFNSDTQA

SEQ ID NO: 200433 - protein, 34 aa, Artificial Sequence
  Description of Artificial Sequence: Synthetic polypeptide
DESEIRTTNPCSTEPWGCIAPEDQQQQQGQGQNS

SEQ ID NO: 200434 - protein, 37 aa, Artificial Sequence
  Description of Artificial Sequence: Synthetic polypeptide
AEEEISTTNPVATEQYGCVCSNWMEHDAENFNSETQS

SEQ ID NO: 200435 - protein, 37 aa, Artificial Sequence
  Description of Artificial Sequence: Synthetic polypeptide
SEEEIRTTNPVATEGYGMVNGQGTFQGEDGGGEQFGD

SEQ ID NO: 200436 - protein, 38 aa, Artificial Sequence
  Description of Artificial Sequence: Synthetic polypeptide
AEEEISTTNPVATEQYGCVCSNWPEDHNAENFNSDTQS

SEQ ID NO: 200437 - protein, 38 aa, Artificial Sequence
  Description of Artificial Sequence: Synthetic polypeptide
DDECIRTTNPVATEQYGQCVCSWGEDHNQENFISDNQA

SEQ ID NO: 200438 - protein, 38 aa, Artificial Sequence
  Description of Artificial Sequence: Synthetic polypeptide
DEECISTTNPVATEQYGQCVCSMWGEHNAENFNSDTQS

SEQ ID NO: 200439 - protein, 37 aa, Artificial Sequence
  Description of Artificial Sequence: Synthetic polypeptide
DEAEIRTTNPVATEQYGQCVCQWADHNIENFMSDTQS

SEQ ID NO: 200440 - protein, 38 aa, Artificial Sequence
  Description of Artificial Sequence: Synthetic polypeptide
DEECISTTNPVATEQYGQCVCSMWGEDNQENFNSDTQS

SEQ ID NO: 200441 - protein, 37 aa, Artificial Sequence
  Description of Artificial Sequence: Synthetic polypeptide
AEEEIATTNPVATEQYGQCSCQWMEDNAEHFNSENQA

SEQ ID NO: 200442 - protein, 34 aa, Artificial Sequence
  Description of Artificial Sequence: Synthetic polypeptide
DESEIRTTNPCSTEPWGCIAPEDDQQQQQQGTNA

SEQ ID NO: 200443 - protein, 39 aa, Artificial Sequence
  Description of Artificial Sequence: Synthetic polypeptide
DEECISTTNPVATEQYGQCVCSMWGEDHNQENFGSDNQS

SEQ ID NO: 200444 - protein, 34 aa, Artificial Sequence
  Description of Artificial Sequence: Synthetic polypeptide
QAEEIATTNPVATASWGCNVAGAGLNTAGFDINF

SEQ ID NO: 200445 - protein, 39 aa, Artificial Sequence
  Description of Artificial Sequence: Synthetic polypeptide
SEEEIRTTNPVATEGYGMVDNNQGTNDDQEGGGGEQFGQ

SEQ ID NO: 200446 - protein, 39 aa, Artificial Sequence
  Description of Artificial Sequence: Synthetic polypeptide
SEEEIRTTNPVATEGYGMVDNGQGTNTDQEGGGGEQAGD

SEQ ID NO: 200447 - protein, 38 aa, Artificial Sequence
  Description of Artificial Sequence: Synthetic polypeptide
AEEEIATTNPVATEQYGQCSCPNWEEDNQEHFISENQA

SEQ ID NO: 200448 - protein, 35 aa, Artificial Sequence
  Description of Artificial Sequence: Synthetic polypeptide
DEFAICTTNPVAFEQWGSDNSEVIQQTMNGMEEAN

SEQ ID NO: 200449 - protein, 38 aa, Artificial Sequence
  Description of Artificial Sequence: Synthetic polypeptide
DEMEISTTNPVATEQYGICVCSNWGEPNIEFFGSDTQS

SEQ ID NO: 200450 - protein, 38 aa, Artificial Sequence
  Description of Artificial Sequence: Synthetic polypeptide
DEECISTTNPVATEQYGQCVCSMWGEHNAEYFNSDNQS

SEQ ID NO: 200451 - protein, 38 aa, Artificial Sequence
  Description of Artificial Sequence: Synthetic polypeptide
DEECISTTNPVATEQYGQCVCSMWGEHNQENFGSDTQA

SEQ ID NO: 200452 - protein, 39 aa, Artificial Sequence
  Description of Artificial Sequence: Synthetic polypeptide
CEAEIRTTNPVATEQYGVVVGNGDTDQEETDGEGEGNGV

SEQ ID NO: 200453 - protein, 39 aa, Artificial Sequence
  Description of Artificial Sequence: Synthetic polypeptide
CEAEIRTTNPVATEQYGVVNGNGQTDQEEQDGEGEGNGE

SEQ ID NO: 200454 - protein, 39 aa, Artificial Sequence
  Description of Artificial Sequence: Synthetic polypeptide
SEEEIRTTNPVATEGYGMVVNGQGTNDDQEGGGEEQFGD

SEQ ID NO: 200455 - protein, 37 aa, Artificial Sequence
  Description of Artificial Sequence: Synthetic polypeptide
AEEEISTTNPVATEQYGCVCSNWGEHNQENFISDTQA

SEQ ID NO: 200456 - protein, 33 aa, Artificial Sequence
  Description of Artificial Sequence: Synthetic polypeptide
AEHEIASTNPVGYEAYGKVMAYSGLSQHVGDMI

SEQ ID NO: 200457 - protein, 39 aa, Artificial Sequence
  Description of Artificial Sequence: Synthetic polypeptide
DEECISTTNPVATEQYGQCVCSNSGEDHNAENFGSDNQS

SEQ ID NO: 200458 - protein, 38 aa, Artificial Sequence
  Description of Artificial Sequence: Synthetic polypeptide
QEVEIRTTNPVATEQYGAVFDNNEMGQNEMTENEGGQE

SEQ ID NO: 200459 - protein, 35 aa, Artificial Sequence
  Description of Artificial Sequence: Synthetic polypeptide
AEEEIATTNPVATEQYGQCYCPWEDNAHFNSETQA

SEQ ID NO: 200460 - protein, 35 aa, Artificial Sequence
  Description of Artificial Sequence: Synthetic polypeptide
SEAEIGCTNPVATEQYGCLLFTATDGPVEFEGNKQ

SEQ ID NO: 200461 - protein, 38 aa, Artificial Sequence
  Description of Artificial Sequence: Synthetic polypeptide
DEMEISTTNPVATEQYGQCVCGNSGEHNIENFNSDTQS

SEQ ID NO: 200462 - protein, 36 aa, Artificial Sequence
  Description of Artificial Sequence: Synthetic polypeptide
AEEEISTTNPVATMQWGTIIPNCIQNMDSTDSGGNG

SEQ ID NO: 200463 - protein, 38 aa, Artificial Sequence
  Description of Artificial Sequence: Synthetic polypeptide
DNSEIRTTNPVATEQYGCLSWHSEYDGLDENIFNLNGD

SEQ ID NO: 200464 - protein, 39 aa, Artificial Sequence
  Description of Artificial Sequence: Synthetic polypeptide
DNSEIRTTNPVATEQYGCLSWHSEYDHLDENIIGDLNGD

SEQ ID NO: 200465 - protein, 40 aa, Artificial Sequence
  Description of Artificial Sequence: Synthetic polypeptide
DNSEIRTTNPVATEQYGQCLSWHSEQDALDENQIGTLNGD

SEQ ID NO: 200466 - protein, 35 aa, Artificial Sequence
  Description of Artificial Sequence: Synthetic polypeptide
ENCEIATTNPVAYEQWGTYYMIQTNDQHEHGNDHH

SEQ ID NO: 200467 - protein, 34 aa, Artificial Sequence
  Description of Artificial Sequence: Synthetic polypeptide
DESEIRTTNPCSTEPWGCIAPEDQQQQQQHGTNS

SEQ ID NO: 200468 - protein, 35 aa, Artificial Sequence
  Description of Artificial Sequence: Synthetic polypeptide
DEDEIRTTNPVAYEQYGQKTAPAFAPSDMPVQNQV

SEQ ID NO: 200469 - protein, 39 aa, Artificial Sequence
  Description of Artificial Sequence: Synthetic polypeptide
DEAEIRTTNPVATEQYGQCVCSMWGEDHNAENFNSDFQA

SEQ ID NO: 200470 - protein, 39 aa, Artificial Sequence
  Description of Artificial Sequence: Synthetic polypeptide
DEAEIRTTNPVATEQYGQCVCSMWGEDHNQENFNSDNQA

SEQ ID NO: 200471 - protein, 37 aa, Artificial Sequence
  Description of Artificial Sequence: Synthetic polypeptide
TEEELQRLTTNPVATEPWGITVSYTPELSQVTVMPEN

SEQ ID NO: 200472 - protein, 37 aa, Artificial Sequence
  Description of Artificial Sequence: Synthetic polypeptide
SEEEIATTNPVATEQWGANRTTAATEHLGAGMAGNNN

SEQ ID NO: 200473 - protein, 38 aa, Artificial Sequence
  Description of Artificial Sequence: Synthetic polypeptide
DEECISTTNPVATEQYGQCVCSNSGEHNAENFISDNQA

SEQ ID NO: 200474 - protein, 38 aa, Artificial Sequence
  Description of Artificial Sequence: Synthetic polypeptide
QEVEIGTTNPVATEQYGTVVDALDGGIEEQEEGGNFDI

SEQ ID NO: 200475 - protein, 37 aa, Artificial Sequence
  Description of Artificial Sequence: Synthetic polypeptide
DEGEIRTTNPVATEQYGCFTYTPMNEDSKIEYPQQPM

SEQ ID NO: 200476 - protein, 35 aa, Artificial Sequence
  Description of Artificial Sequence: Synthetic polypeptide
VESEIRTTNPVSTEPWGCIAPEDLQPQQQQRGTES

SEQ ID NO: 200477 - protein, 38 aa, Artificial Sequence
  Description of Artificial Sequence: Synthetic polypeptide
QEVEIGTTNPVATEQYGTVVSATDDGGEEEEEGGNNDI

SEQ ID NO: 200478 - protein, 38 aa, Artificial Sequence
  Description of Artificial Sequence: Synthetic polypeptide
SEEEIRTTNPVATEQYGCVCGNWGEDHNAENFNSDNQA

SEQ ID NO: 200479 - protein, 37 aa, Artificial Sequence
  Description of Artificial Sequence: Synthetic polypeptide
CEEEISCTNPVATEQYGCVCSNWGEHNAENFNSDTQP

SEQ ID NO: 200480 - protein, 37 aa, Artificial Sequence
  Description of Artificial Sequence: Synthetic polypeptide
QEVEIGTTNPVATEQYGTVVSGQDGGDEEEEGGNNGI

SEQ ID NO: 200481 - protein, 38 aa, Artificial Sequence
  Description of Artificial Sequence: Synthetic polypeptide
DEEEISTTNPVATEGYGQCVCSWGEDHNQENFNSDNQI

SEQ ID NO: 200482 - protein, 38 aa, Artificial Sequence
  Description of Artificial Sequence: Synthetic polypeptide
DEGEIRTTNPVATEQYGCFTYTPMNEDWKIETPQQCPM

SEQ ID NO: 200483 - protein, 38 aa, Artificial Sequence
  Description of Artificial Sequence: Synthetic polypeptide
DEEEISTTNPVATEGYGQCVCSWGEDHNAENFNSDTQA

SEQ ID NO: 200484 - protein, 38 aa, Artificial Sequence
  Description of Artificial Sequence: Synthetic polypeptide
DEAEISTTNPVATEQYGCVCSNSGEDHNAEFFNSDFQS

SEQ ID NO: 200485 - protein, 38 aa, Artificial Sequence
  Description of Artificial Sequence: Synthetic polypeptide
DEAEISTTNPVATEQYGCVCSNSGEDHNAENFNSDTQG

SEQ ID NO: 200486 - protein, 37 aa, Artificial Sequence
  Description of Artificial Sequence: Synthetic polypeptide
DEMEIATTNPVATCQYGQCVCSWGEDNAENFGSDTQA

SEQ ID NO: 200487 - protein, 37 aa, Artificial Sequence
  Description of Artificial Sequence: Synthetic polypeptide
DETEIACTNPVATEQYGSACSAVGPDQNDSGDDQAVE

SEQ ID NO: 200488 - protein, 37 aa, Artificial Sequence
  Description of Artificial Sequence: Synthetic polypeptide
SEEEIATTNPVATEQWGANRTTAATEHLEAGMGNEHN

SEQ ID NO: 200489 - protein, 37 aa, Artificial Sequence
  Description of Artificial Sequence: Synthetic polypeptide
QEVEIGTTNPVATEQYGAVVNGTDGGDEEEEGGINDI

SEQ ID NO: 200490 - protein, 38 aa, Artificial Sequence
  Description of Artificial Sequence: Synthetic polypeptide
DETEIACTNPVATEQYGSACSPANDPSPLIDAEEGKME

SEQ ID NO: 200491 - protein, 38 aa, Artificial Sequence
  Description of Artificial Sequence: Synthetic polypeptide
DEECISTTNPVATEQYGQCVCSNSGEHNAENFNSDTQA

SEQ ID NO: 200492 - protein, 38 aa, Artificial Sequence
  Description of Artificial Sequence: Synthetic polypeptide
QEVEICTTNPVATEQYGTVVSATDGDDEMTEEGGNFDI

SEQ ID NO: 200493 - protein, 38 aa, Artificial Sequence
  Description of Artificial Sequence: Synthetic polypeptide
SEEEIRTTNPVATEQYGCVCSNWGEDHNAENFISDTQS

SEQ ID NO: 200494 - protein, 38 aa, Artificial Sequence
  Description of Artificial Sequence: Synthetic polypeptide
SEEEIRTTNPVATEQYGCVCSNWGEDDNQENFISDTQS

SEQ ID NO: 200495 - protein, 37 aa, Artificial Sequence
  Description of Artificial Sequence: Synthetic polypeptide
DMSEIRTTNPVATEQYGSTCSSTAVEHKDEETLFEEH

SEQ ID NO: 200496 - protein, 35 aa, Artificial Sequence
  Description of Artificial Sequence: Synthetic polypeptide
DNAEIRTTNPVSYEPWGKISCIEDSISDQMNGGNF

SEQ ID NO: 200497 - protein, 38 aa, Artificial Sequence
  Description of Artificial Sequence: Synthetic polypeptide
DDEEIKTTNPVATEFYGQVNFNMDLQLDQGGGGGEQGQ

SEQ ID NO: 200498 - protein, 39 aa, Artificial Sequence
  Description of Artificial Sequence: Synthetic polypeptide
DEAEIRTTNPVATEQYGQCVCSNWMEDHNAENFNSQTQS

SEQ ID NO: 200499 - protein, 35 aa, Artificial Sequence
  Description of Artificial Sequence: Synthetic polypeptide
CETEIACTNPVATEQWGCVAGTEGLEAGPQEEDAV

SEQ ID NO: 200500 - protein, 37 aa, Artificial Sequence
  Description of Artificial Sequence: Synthetic polypeptide
QEVEIGTTNPVATEFYGTVVSVTDGGDEEEEGGNFNI

SEQ ID NO: 200501 - protein, 37 aa, Artificial Sequence
  Description of Artificial Sequence: Synthetic polypeptide
QEVEIGTTNPVATEFYGVVVSGTDGGDEEEEGGNFDI

SEQ ID NO: 200502 - protein, 34 aa, Artificial Sequence
  Description of Artificial Sequence: Synthetic polypeptide
DDSEVACTNPVSTEGYGNVCYNTIDQSRHGSQQD

SEQ ID NO: 200503 - protein, 39 aa, Artificial Sequence
  Description of Artificial Sequence: Synthetic polypeptide
TEEELATTNPVAYEQYGSTVPADTGNSSSLNILGGVERI

SEQ ID NO: 200504 - protein, 37 aa, Artificial Sequence
  Description of Artificial Sequence: Synthetic polypeptide
SEEEIATTNPVATEQWGANRTTAATEHALAGMGNNHE

SEQ ID NO: 200505 - protein, 37 aa, Artificial Sequence
  Description of Artificial Sequence: Synthetic polypeptide
SEEEIATTNPVATEQWGANRTTAATEHLAGMPGNNHN

SEQ ID NO: 200506 - protein, 38 aa, Artificial Sequence
  Description of Artificial Sequence: Synthetic polypeptide
DEECISTTNPVATEQYGQCVCSNWEEHNAESFNSDTQS

SEQ ID NO: 200507 - protein, 38 aa, Artificial Sequence
  Description of Artificial Sequence: Synthetic polypeptide
DEEEISTTNPVATEGYGQCVCSNWMEHNAENFNSETQA

SEQ ID NO: 200508 - protein, 38 aa, Artificial Sequence
  Description of Artificial Sequence: Synthetic polypeptide
SEEEIRTTNPVATEQYGCTCSNWGEDHNAENFNSDTQA

SEQ ID NO: 200509 - protein, 37 aa, Artificial Sequence
  Description of Artificial Sequence: Synthetic polypeptide
QEVEIGTTNPVATEQYGVVVQGTDEGDEEEEGGNNDI

SEQ ID NO: 200510 - protein, 37 aa, Artificial Sequence
  Description of Artificial Sequence: Synthetic polypeptide
QEVEIGTTNPVATEQYGVVVSGTDDGDEEEEGGEGDI

SEQ ID NO: 200511 - protein, 38 aa, Artificial Sequence
  Description of Artificial Sequence: Synthetic polypeptide
QEVEIGTTNPVATEQYGVVVSGTDDGDEEGEEGGNNDI

SEQ ID NO: 200512 - protein, 37 aa, Artificial Sequence
  Description of Artificial Sequence: Synthetic polypeptide
DEMEIVTTNPVATEQYGQCVCSNWGEPNEFFNSDTQA

SEQ ID NO: 200513 - protein, 37 aa, Artificial Sequence
  Description of Artificial Sequence: Synthetic polypeptide
DEMEIATTNPVATCQYGQCVCSNWGAHNQNFGSDTQS

SEQ ID NO: 200514 - protein, 33 aa, Artificial Sequence
  Description of Artificial Sequence: Synthetic polypeptide
ENAEACCTNPVAYECWGVVAWNENQDQHGNTDR

SEQ ID NO: 200515 - protein, 35 aa, Artificial Sequence
  Description of Artificial Sequence: Synthetic polypeptide
CEAEIRTTNPVSYEGWGKISCMEDSISDQMNGGNT

SEQ ID NO: 200516 - protein, 37 aa, Artificial Sequence
  Description of Artificial Sequence: Synthetic polypeptide
CETEIACTNPVATEQYGSACSANDDIGQPDDLMGDLH

SEQ ID NO: 200517 - protein, 38 aa, Artificial Sequence
  Description of Artificial Sequence: Synthetic polypeptide
DEEEISTTNPVATEGYGQCVCSNWGEHNQENFGSDTQS

SEQ ID NO: 200518 - protein, 37 aa, Artificial Sequence
  Description of Artificial Sequence: Synthetic polypeptide
QEVEIGTTNPVATEQYGVVVTGTDGGDEEEEGGDNDI

SEQ ID NO: 200519 - protein, 38 aa, Artificial Sequence
  Description of Artificial Sequence: Synthetic polypeptide
DEMEISTTNPVATEQYGICVCSNWGEHNAEFFGSDTQA

SEQ ID NO: 200520 - protein, 39 aa, Artificial Sequence
  Description of Artificial Sequence: Synthetic polypeptide
DENEIRTTNPVATEQYGSTIPWTPPLEENQVHSDIEYMQ

SEQ ID NO: 200521 - protein, 35 aa, Artificial Sequence
  Description of Artificial Sequence: Synthetic polypeptide
AEAEIATTNPVATEQYGCYCPWGEDNQHFNSETQA

SEQ ID NO: 200522 - protein, 38 aa, Artificial Sequence
  Description of Artificial Sequence: Synthetic polypeptide
QEVEIGTTNPVATEQYGVVVVSGTDGGDEEEDGGNNDI

SEQ ID NO: 200523 - protein, 38 aa, Artificial Sequence
  Description of Artificial Sequence: Synthetic polypeptide
QEVEIGTTNPVATEQYGVVVVSGTDGGDEEEEGGNADA

SEQ ID NO: 200524 - protein, 38 aa, Artificial Sequence
  Description of Artificial Sequence: Synthetic polypeptide
QEVEIGTTNPVATEQYGVVVLGTDGGDEENEEGGNNDI

SEQ ID NO: 200525 - protein, 38 aa, Artificial Sequence
  Description of Artificial Sequence: Synthetic polypeptide
DEEEISTTNPVATEGYGQCVCSNWGEPNQEFFNSDNQS

SEQ ID NO: 200526 - protein, 37 aa, Artificial Sequence
  Description of Artificial Sequence: Synthetic polypeptide
QEVEIGTTNPVATEQYGVVVGGTDGDDEEEEGGNNDI

SEQ ID NO: 200527 - protein, 39 aa, Artificial Sequence
  Description of Artificial Sequence: Synthetic polypeptide
DEAEIRTTNPVATEQYGQCVCSNWGEDHDAENFNSDNQS

SEQ ID NO: 200528 - protein, 38 aa, Artificial Sequence
  Description of Artificial Sequence: Synthetic polypeptide
DEECISTTNPVATEQYGQCVCSNSGEHNAENFGSDTQS

SEQ ID NO: 200529 - protein, 38 aa, Artificial Sequence
  Description of Artificial Sequence: Synthetic polypeptide
DEEEISTTNPVATEGYGQCVCSNWGEHNTENFNSETQA

SEQ ID NO: 200530 - protein, 38 aa, Artificial Sequence
  Description of Artificial Sequence: Synthetic polypeptide
DEMEIATTNPVATCQYGQCVCSNWMAHNQENFGSDNQS

SEQ ID NO: 200531 - protein, 38 aa, Artificial Sequence
  Description of Artificial Sequence: Synthetic polypeptide
DEEEISTTNPVATEGYGQCVCSNWGEHNTENFNSDTQS

SEQ ID NO: 200532 - protein, 39 aa, Artificial Sequence
  Description of Artificial Sequence: Synthetic polypeptide
DEAEIRTTNPVATEQYGQCVCSNWGEDHNQEYFGSDTQA

SEQ ID NO: 200533 - protein, 37 aa, Artificial Sequence
  Description of Artificial Sequence: Synthetic polypeptide
QEVEIGTTNPVATEQYGVVVDGTDGGDEEEEGGNNLI

SEQ ID NO: 200534 - protein, 36 aa, Artificial Sequence
  Description of Artificial Sequence: Synthetic polypeptide
DAEEIATTNPVAYEQWGCNTAGNNGLTTAEGGNADT

SEQ ID NO: 200535 - protein, 39 aa, Artificial Sequence
  Description of Artificial Sequence: Synthetic polypeptide
DEAEIRTTNPVATEQYGQCVCSNWGEDHNQENFPSDNQA

SEQ ID NO: 200536 - protein, 39 aa, Artificial Sequence
  Description of Artificial Sequence: Synthetic polypeptide
DEAEIRTTNPVATEQYGQCVCSNWGEDHNQENFISENQS

SEQ ID NO: 200537 - protein, 39 aa, Artificial Sequence
  Description of Artificial Sequence: Synthetic polypeptide
DEAEIRTTNPVATEQYGQCVCSNWGEDHNIEFFNSDTQS

SEQ ID NO: 200538 - protein, 39 aa, Artificial Sequence
  Description of Artificial Sequence: Synthetic polypeptide
DEAEIRTTNPVATEQYGQCVCSNWGEDHNAENFNSDTQG

SEQ ID NO: 200539 - protein, 39 aa, Artificial Sequence
  Description of Artificial Sequence: Synthetic polypeptide
DEAEIRTTNPVATEQYGQCVCSNWGEDHNAENFNSDTQA

SEQ ID NO: 200540 - protein, 39 aa, Artificial Sequence
  Description of Artificial Sequence: Synthetic polypeptide
DEAEIRTTNPVATEQYGQCVCSNWGEDHNAENFNSDNQN

SEQ ID NO: 200541 - protein, 39 aa, Artificial Sequence
  Description of Artificial Sequence: Synthetic polypeptide
DEAEIRTTNPVATEQYGQCVCSNWGEDHNAENFISENQP

SEQ ID NO: 200542 - protein, 39 aa, Artificial Sequence
  Description of Artificial Sequence: Synthetic polypeptide
DEGEIRTTNPVATEQYGCLSNGPTLLALNIPQHTDEDDS

SEQ ID NO: 200543 - protein, 38 aa, Artificial Sequence
  Description of Artificial Sequence: Synthetic polypeptide
DEEEIATTNPVATEQWGQCVCSNWMYDNAENFNSQTQS

SEQ ID NO: 200544 - protein, 39 aa, Artificial Sequence
  Description of Artificial Sequence: Synthetic polypeptide
DEECIRTTNPVATEQYGQCVCSNWGEDHNQESFNSDTQS

SEQ ID NO: 200545 - protein, 34 aa, Artificial Sequence
  Description of Artificial Sequence: Synthetic polypeptide
TEDEIASVNPVCYEPYGVTVNTINLSYNAGGNNV

SEQ ID NO: 200546 - protein, 32 aa, Artificial Sequence
  Description of Artificial Sequence: Synthetic polypeptide
DDSEVGSTNPVSTEGYGVAVAANTIVSGVGQQ

SEQ ID NO: 200547 - protein, 36 aa, Artificial Sequence
  Description of Artificial Sequence: Synthetic polypeptide
CDEEISTTNPVATEQYGCVCSWGEHNIENFISDFQS

SEQ ID NO: 200548 - protein, 35 aa, Artificial Sequence
  Description of Artificial Sequence: Synthetic polypeptide
QEGEIAPTNPCSYEAYGVTVSCCNMLSQENGGTDR

SEQ ID NO: 200549 - protein, 38 aa, Artificial Sequence
  Description of Artificial Sequence: Synthetic polypeptide
DENEISTTNPVAYEQWGSVSGGPPGNGGNMRNMEGMSN

SEQ ID NO: 200550 - protein, 36 aa, Artificial Sequence
  Description of Artificial Sequence: Synthetic polypeptide
DSAEIRTTNPVSYEPWGKISCMEDSISDQMNGGNFR

SEQ ID NO: 200551 - protein, 38 aa, Artificial Sequence
  Description of Artificial Sequence: Synthetic polypeptide
DETAEIATTNPVATEQWGSVAYANDTLGDEHGDIADFH

SEQ ID NO: 200552 - protein, 38 aa, Artificial Sequence
  Description of Artificial Sequence: Synthetic polypeptide
DEECISTTNPVATEQYGCVCSNWGEDHNAENFNSDNQS

SEQ ID NO: 200553 - protein, 36 aa, Artificial Sequence
  Description of Artificial Sequence: Synthetic polypeptide
DEEEIATTNPVAYEKWGCVYNLPDNHNGTQLGMTGS

SEQ ID NO: 200554 - protein, 38 aa, Artificial Sequence
  Description of Artificial Sequence: Synthetic polypeptide
DEEEIATTNPVATEAYGKTVPHPTPAGSQQPNTTDYMY

SEQ ID NO: 200555 - protein, 39 aa, Artificial Sequence
  Description of Artificial Sequence: Synthetic polypeptide
DEEEIRTTNPVATEQYGTSYTIHPCSVEEYAEVIGTPEL

SEQ ID NO: 200556 - protein, 34 aa, Artificial Sequence
  Description of Artificial Sequence: Synthetic polypeptide
DENEIRTTNPVATECWGATTANAEDWAEPAEPYI

SEQ ID NO: 200557 - protein, 35 aa, Artificial Sequence
  Description of Artificial Sequence: Synthetic polypeptide
DSAEIRTTNPVGYECYGNIFYTNAHSETNEGPYYR

SEQ ID NO: 200558 - protein, 33 aa, Artificial Sequence
  Description of Artificial Sequence: Synthetic polypeptide
DSEDIATTNPVATAQWGGCCAAPADHGRDSGGN

SEQ ID NO: 200559 - protein, 39 aa, Artificial Sequence
  Description of Artificial Sequence: Synthetic polypeptide
DEECIRTTNPVATEQYGQCVCSNWGEDHNAENFNSDTQA

SEQ ID NO: 200560 - protein, 36 aa, Artificial Sequence
  Description of Artificial Sequence: Synthetic polypeptide
TENCIRATNPVATERYGICVSCELNEVSQFVGGEDC

SEQ ID NO: 200561 - protein, 38 aa, Artificial Sequence
  Description of Artificial Sequence: Synthetic polypeptide
DDEEISTTNPVATEGYGCVCSTWGEDHNAENFNSETQS

SEQ ID NO: 200562 - protein, 32 aa, Artificial Sequence
  Description of Artificial Sequence: Synthetic polypeptide
QESEIASTNPVGTEGWGATANSTWAEPKGPYI

SEQ ID NO: 200563 - protein, 35 aa, Artificial Sequence
  Description of Artificial Sequence: Synthetic polypeptide
TEGQEIATTNPVAYEQWGTVYYGELNDNQNGHTDV

SEQ ID NO: 200564 - protein, 39 aa, Artificial Sequence
  Description of Artificial Sequence: Synthetic polypeptide
DEEEIVTTNPVATEGYGVVDVGVGNGNVGQEEGEGNDTI

SEQ ID NO: 200565 - protein, 36 aa, Artificial Sequence
  Description of Artificial Sequence: Synthetic polypeptide
DEHENATTNPVAYEQWGEVCSTPNQGNHGEAGDGKN

SEQ ID NO: 200566 - protein, 39 aa, Artificial Sequence
  Description of Artificial Sequence: Synthetic polypeptide
CEEEIATTNPVATEQYGKTVPHPTGPAGSQQPNTDDYRY

SEQ ID NO: 200567 - protein, 38 aa, Artificial Sequence
  Description of Artificial Sequence: Synthetic polypeptide
DEECISTTNPVATEQYGCVCSNWGEDHNAENFNSDNQA

SEQ ID NO: 200568 - protein, 38 aa, Artificial Sequence
  Description of Artificial Sequence: Synthetic polypeptide
TEMEIRTTNPVATEQYGQCVCNNWGEHNAEYFGSDNQA

SEQ ID NO: 200569 - protein, 38 aa, Artificial Sequence
  Description of Artificial Sequence: Synthetic polypeptide
DEEEIACTNPVATEQYGCSSAANTHGPEAGGNLMENPN

SEQ ID NO: 200570 - protein, 38 aa, Artificial Sequence
  Description of Artificial Sequence: Synthetic polypeptide
QEEEIATTNPVTTEHWGSVYCWISNDQDDQRQGGDRSI

SEQ ID NO: 200571 - protein, 35 aa, Artificial Sequence
  Description of Artificial Sequence: Synthetic polypeptide
DETAEIATTNPVAYEAWGVVWPGPNNENDGQEGSE

SEQ ID NO: 200572 - protein, 38 aa, Artificial Sequence
  Description of Artificial Sequence: Synthetic polypeptide
DEAEISTTNPVATEQYGCVCSNWGEDHNAENFISENQA

SEQ ID NO: 200573 - protein, 38 aa, Artificial Sequence
  Description of Artificial Sequence: Synthetic polypeptide
SEAEIATTNPVATEQYGSVCAVHNSVEGAGASIDNSDM

SEQ ID NO: 200574 - protein, 37 aa, Artificial Sequence
  Description of Artificial Sequence: Synthetic polypeptide
TEHEIATTNPVAYEQWGEVCSTPNQGNHGLAGGDGQN

SEQ ID NO: 200575 - protein, 38 aa, Artificial Sequence
  Description of Artificial Sequence: Synthetic polypeptide
CEEEIATTNPVATEQYGQCVCSNWGEHNQENFNSDNQS

SEQ ID NO: 200576 - protein, 38 aa, Artificial Sequence
  Description of Artificial Sequence: Synthetic polypeptide
DEAEISTTNPVATEQYGCVCSNWGEDHNAEGFNSDTQS

SEQ ID NO: 200577 - protein, 37 aa, Artificial Sequence
  Description of Artificial Sequence: Synthetic polypeptide
CEEEIACTNPVATEQYGSCAAAPGNHPMAGMEIENNT

SEQ ID NO: 200578 - protein, 39 aa, Artificial Sequence
  Description of Artificial Sequence: Synthetic polypeptide
DEEEIRTTNPVATEQYGFCWNYLGTSDESEGEYGENKIE

SEQ ID NO: 200579 - protein, 37 aa, Artificial Sequence
  Description of Artificial Sequence: Synthetic polypeptide
DEAEIACTNPVATEQYGSVCAAIEHLDAGDLLDEDAH

SEQ ID NO: 200580 - protein, 37 aa, Artificial Sequence
  Description of Artificial Sequence: Synthetic polypeptide
DEQEIATTNPVAYEQYGVSTVCAMIEGLGPPDGPSDM

SEQ ID NO: 200581 - protein, 37 aa, Artificial Sequence
  Description of Artificial Sequence: Synthetic polypeptide
DEEEISTTNPVATEGYGCVCGWGEDHNTENFNSETQS

SEQ ID NO: 200582 - protein, 38 aa, Artificial Sequence
  Description of Artificial Sequence: Synthetic polypeptide
SEAEIATTNPVATEQYGSVCADHNSVEGATNSIDNSDM

SEQ ID NO: 200583 - protein, 37 aa, Artificial Sequence
  Description of Artificial Sequence: Synthetic polypeptide
DEEAIRTTNPVATEGYGCVCSNWGEHNAENFISDTQS

SEQ ID NO: 200584 - protein, 37 aa, Artificial Sequence
  Description of Artificial Sequence: Synthetic polypeptide
DEECISTTNPVATEQYGCVCENWEEHNEENFNSDTQA

SEQ ID NO: 200585 - protein, 37 aa, Artificial Sequence
  Description of Artificial Sequence: Synthetic polypeptide
AEEEIATTNPVATEQYGCFCPNWGEDNQEHFNSETQA

SEQ ID NO: 200586 - protein, 37 aa, Artificial Sequence
  Description of Artificial Sequence: Synthetic polypeptide
CDEEISTTNPVATEQYGCVCSWGEAHNAENFNSDNQS

SEQ ID NO: 200587 - protein, 38 aa, Artificial Sequence
  Description of Artificial Sequence: Synthetic polypeptide
TEGPEIATTNPVAYEQWGSCVTNGGNAGEMLRREGNAA

SEQ ID NO: 200588 - protein, 33 aa, Artificial Sequence
  Description of Artificial Sequence: Synthetic polypeptide
DSEDIATTNPVATAQWGGCCAPADHGIRDSNGN

SEQ ID NO: 200589 - protein, 38 aa, Artificial Sequence
  Description of Artificial Sequence: Synthetic polypeptide
DEAEISTTNPVATEQYGCVCSNWGEDHNEEGFISENQA

SEQ ID NO: 200590 - protein, 38 aa, Artificial Sequence
  Description of Artificial Sequence: Synthetic polypeptide
DEAEIRSTNPVATDQYGVVNDNSIGQNGGQGDNDDTDG

SEQ ID NO: 200591 - protein, 36 aa, Artificial Sequence
  Description of Artificial Sequence: Synthetic polypeptide
DETEIACTNPVATAQWGSVSATGDEEAGTEMGEDAS

SEQ ID NO: 200592 - protein, 40 aa, Artificial Sequence
  Description of Artificial Sequence: Synthetic polypeptide
DEEEIRTTNPVATEQYGTTYAIYPTATSVHVVSPFQNERN

SEQ ID NO: 200593 - protein, 35 aa, Artificial Sequence
  Description of Artificial Sequence: Synthetic polypeptide
CEDWIATTNPVATAQWGCVAIANNLPTEAPGGNMN

SEQ ID NO: 200594 - protein, 38 aa, Artificial Sequence
  Description of Artificial Sequence: Synthetic polypeptide
DEAEISTVNPVATEQYGCVCSNTGEDDNAENFISDNQA

SEQ ID NO: 200595 - protein, 38 aa, Artificial Sequence
  Description of Artificial Sequence: Synthetic polypeptide
DEHEIRTTNPVATEQYGSNIVTPHPDEEQNNEPETMDV

SEQ ID NO: 200596 - protein, 37 aa, Artificial Sequence
  Description of Artificial Sequence: Synthetic polypeptide
NDEEIRTTNPVATEGYGQCVCSWGEHNAENFNSDTQS

SEQ ID NO: 200597 - protein, 38 aa, Artificial Sequence
  Description of Artificial Sequence: Synthetic polypeptide
DEECISTTNPVATEQYGCVCSNWGEDHNAENFNSDTQA

SEQ ID NO: 200598 - protein, 37 aa, Artificial Sequence
  Description of Artificial Sequence: Synthetic polypeptide
SEAEIATTNPVATEQYGSVCAAMAHDEAGMPPDNPNH

SEQ ID NO: 200599 - protein, 35 aa, Artificial Sequence
  Description of Artificial Sequence: Synthetic polypeptide
DEDEIATTNPVATEQWGCNAGNEGLEATMDIDSDM

SEQ ID NO: 200600 - protein, 36 aa, Artificial Sequence
  Description of Artificial Sequence: Synthetic polypeptide
DETEIACTNPVATAQWGSVSVSGDPEENTGGVEENV

SEQ ID NO: 200601 - protein, 39 aa, Artificial Sequence
  Description of Artificial Sequence: Synthetic polypeptide
DENEIRTTNPVATEQYGECVVDTDAENGSDETQEESQVE

SEQ ID NO: 200602 - protein, 37 aa, Artificial Sequence
  Description of Artificial Sequence: Synthetic polypeptide
AEDEICATNPVATEQYGVVATVANNNNQQLNGIGTDQ

SEQ ID NO: 200603 - protein, 34 aa, Artificial Sequence
  Description of Artificial Sequence: Synthetic polypeptide
AESEIATTNPVAYEAWGVVYGGWDDQPGQGNTGN

SEQ ID NO: 200604 - protein, 38 aa, Artificial Sequence
  Description of Artificial Sequence: Synthetic polypeptide
DEMEISTTNPVATEQYGQCVCSNWGEDPNEFFGSDTQA

SEQ ID NO: 200605 - protein, 38 aa, Artificial Sequence
  Description of Artificial Sequence: Synthetic polypeptide
DEECISTTNPVATEQYGCVCSNWGEDHNAENFNSDTQS

SEQ ID NO: 200606 - protein, 35 aa, Artificial Sequence
  Description of Artificial Sequence: Synthetic polypeptide
VEDEIATTNPVAYEQWGTACAATAGELPDSAENGR

SEQ ID NO: 200607 - protein, 33 aa, Artificial Sequence
  Description of Artificial Sequence: Synthetic polypeptide
DENEIRTTNPVATECWGATTAEEDWAEPAEPYI

SEQ ID NO: 200608 - protein, 38 aa, Artificial Sequence
  Description of Artificial Sequence: Synthetic polypeptide
TENEIGTTNPVATEQYGSTVICPVSLAQQVLTPGGAVS

SEQ ID NO: 200609 - protein, 38 aa, Artificial Sequence
  Description of Artificial Sequence: Synthetic polypeptide
DEEEIRTTNPVAYEGYGQCVCSMWGEHNAENFNSENQP

SEQ ID NO: 200610 - protein, 38 aa, Artificial Sequence
  Description of Artificial Sequence: Synthetic polypeptide
TEGPEIATTNPVAYEQWGSCVQNGGNAGEMLRREGNAD

SEQ ID NO: 200611 - protein, 38 aa, Artificial Sequence
  Description of Artificial Sequence: Synthetic polypeptide
DEAEISTTNPVATEQYGCVCSNWGEDDNEENFNSDTQS

SEQ ID NO: 200612 - protein, 35 aa, Artificial Sequence
  Description of Artificial Sequence: Synthetic polypeptide
DSAEIRTTNPVCYECYGAIIFYTNAHSENEGPYQR

SEQ ID NO: 200613 - protein, 37 aa, Artificial Sequence
  Description of Artificial Sequence: Synthetic polypeptide
DETAEIATTNPVATEQWGCVAATAHGEDDMNPGEENW

SEQ ID NO: 200614 - protein, 33 aa, Artificial Sequence
  Description of Artificial Sequence: Synthetic polypeptide
DENEIRTTNPVATECWGATTAEEDWAEPAEPYA

SEQ ID NO: 200615 - protein, 37 aa, Artificial Sequence
  Description of Artificial Sequence: Synthetic polypeptide
DDSCIATTNPVATEQYGCVCVWWPNVIIDNSGQNPRT

SEQ ID NO: 200616 - protein, 35 aa, Artificial Sequence
  Description of Artificial Sequence: Synthetic polypeptide
DSAEIRTTNPVCYECYGAIFYTNAHSHNDEGPYYR

SEQ ID NO: 200617 - protein, 37 aa, Artificial Sequence
  Description of Artificial Sequence: Synthetic polypeptide
DDEEISTTNPVATEGYGCVCSNWGEHNTENFNSDPQS

SEQ ID NO: 200618 - protein, 37 aa, Artificial Sequence
  Description of Artificial Sequence: Synthetic polypeptide
DETAEIATTNPVATEQWGCVAAPAHGGEDNMNPGENW

SEQ ID NO: 200619 - protein, 35 aa, Artificial Sequence
  Description of Artificial Sequence: Synthetic polypeptide
DSAEIRTTNPVCYECYGAIFYTNAHSETNEGPYAR

SEQ ID NO: 200620 - protein, 37 aa, Artificial Sequence
  Description of Artificial Sequence: Synthetic polypeptide
DDEEISTTNPVATEGYGCVCSNWGEHNQENFGSETQA

SEQ ID NO: 200621 - protein, 36 aa, Artificial Sequence
  Description of Artificial Sequence: Synthetic polypeptide
DEHEIRSTNPVAYECWGCVFGGNGETERNNMGNGNQ

SEQ ID NO: 200622 - protein, 38 aa, Artificial Sequence
  Description of Artificial Sequence: Synthetic polypeptide
DEECISTTNPVATEQYGCVCSNSGEDHNAENFNSDNQS

SEQ ID NO: 200623 - protein, 33 aa, Artificial Sequence
  Description of Artificial Sequence: Synthetic polypeptide
QECEICATNPCTTEIYGVVATTQAGTNQNGTDT

SEQ ID NO: 200624 - protein, 35 aa, Artificial Sequence
  Description of Artificial Sequence: Synthetic polypeptide
QSGEIAPTNPCSYEQYGVTVSCCNMLSQHVGGTDR

SEQ ID NO: 200625 - protein, 37 aa, Artificial Sequence
  Description of Artificial Sequence: Synthetic polypeptide
CEEEISTTNPVATEQYGCAVCQWGEHNQENFNSDTQS

SEQ ID NO: 200626 - protein, 38 aa, Artificial Sequence
  Description of Artificial Sequence: Synthetic polypeptide
DEAEIRCTNPVATEQYGQCVCSNWGEHNDEHFGSDTQS

SEQ ID NO: 200627 - protein, 35 aa, Artificial Sequence
  Description of Artificial Sequence: Synthetic polypeptide
DETEIACTNPVATAQWGHSASLAGMGTSAEQPLEN

SEQ ID NO: 200628 - protein, 37 aa, Artificial Sequence
  Description of Artificial Sequence: Synthetic polypeptide
DEAEISTTNPVATEQYGCVCSNWGEHNAEYFISDTQS

SEQ ID NO: 200629 - protein, 38 aa, Artificial Sequence
  Description of Artificial Sequence: Synthetic polypeptide
DEECISTTNPVATEQYGCVCSNWGEDHNAEGFNSENQA

SEQ ID NO: 200630 - protein, 34 aa, Artificial Sequence
  Description of Artificial Sequence: Synthetic polypeptide
DENEISTTNPVSYEPWGKISCMEDISQQQNGGNH

SEQ ID NO: 200631 - protein, 38 aa, Artificial Sequence
  Description of Artificial Sequence: Synthetic polypeptide
DEAEISTTNPVATEQYGCVCSNWGEDHNAENFNSDTQS

SEQ ID NO: 200632 - protein, 38 aa, Artificial Sequence
  Description of Artificial Sequence: Synthetic polypeptide
CEEEIACTNPVATEQWGHTTAKSGNILTAPDDQMENRM

SEQ ID NO: 200633 - protein, 35 aa, Artificial Sequence
  Description of Artificial Sequence: Synthetic polypeptide
DEACISTTNPLATEQFGCVCSWGEHNQSFGSDTQA

SEQ ID NO: 200634 - protein, 37 aa, Artificial Sequence
  Description of Artificial Sequence: Synthetic polypeptide
AEEEIATTNPVATEQWGSVSVADGPGMTVHGGDLAVM

SEQ ID NO: 200635 - protein, 37 aa, Artificial Sequence
  Description of Artificial Sequence: Synthetic polypeptide
VEDEIATTNPVAYEQYGSACPTNPELGQEHQDDQDAH

SEQ ID NO: 200636 - protein, 38 aa, Artificial Sequence
  Description of Artificial Sequence: Synthetic polypeptide
DETAEIATTNPVAYEQWGSVVCNTPDDDHRQNGKGDIR

SEQ ID NO: 200637 - protein, 39 aa, Artificial Sequence
  Description of Artificial Sequence: Synthetic polypeptide
DEMEISTTNPVATEQYGQCVCSNWGEDHNTENFISDNQS

SEQ ID NO: 200638 - protein, 35 aa, Artificial Sequence
  Description of Artificial Sequence: Synthetic polypeptide
DEAEIRCTNPVSYEPWGKTSCMEDSISDQMTGGNT

SEQ ID NO: 200639 - protein, 37 aa, Artificial Sequence
  Description of Artificial Sequence: Synthetic polypeptide
DEECISTTNPVATEQYGCVCGNWGEHNAENFNSDNQS

SEQ ID NO: 200640 - protein, 38 aa, Artificial Sequence
  Description of Artificial Sequence: Synthetic polypeptide
DETAEIATTNPVAYEQWGSVSYANDPLGDEHGDIAEFH

SEQ ID NO: 200641 - protein, 37 aa, Artificial Sequence
  Description of Artificial Sequence: Synthetic polypeptide
DETAEIATTNPVAYEQYGSVAITPHEEATGGGMEMSM

SEQ ID NO: 200642 - protein, 34 aa, Artificial Sequence
  Description of Artificial Sequence: Synthetic polypeptide
ENEEIATTNPVAYEQWGVYATWEDQGDLGPAMPG

SEQ ID NO: 200643 - protein, 38 aa, Artificial Sequence
  Description of Artificial Sequence: Synthetic polypeptide
DEAEISTTNPVATEQYGCVCSNWGEDHNAENFNSQTQS

SEQ ID NO: 200644 - protein, 34 aa, Artificial Sequence
  Description of Artificial Sequence: Synthetic polypeptide
DEMEIACTNPVATEQWGTNCAATAGGVEPEIQND

SEQ ID NO: 200645 - protein, 39 aa, Artificial Sequence
  Description of Artificial Sequence: Synthetic polypeptide
DEECIRTTNPVATEQYGQCVCSNWGEDENAEYFNSDNQA

SEQ ID NO: 200646 - protein, 38 aa, Artificial Sequence
  Description of Artificial Sequence: Synthetic polypeptide
DEHNEIATTNPVAYEQWGEVCSTPNQGNHGENGGGGNN

SEQ ID NO: 200647 - protein, 36 aa, Artificial Sequence
  Description of Artificial Sequence: Synthetic polypeptide
VEDEIATTNPVAYEQWGSVCTDTPLPNDSGDGEGHN

SEQ ID NO: 200648 - protein, 35 aa, Artificial Sequence
  Description of Artificial Sequence: Synthetic polypeptide
DEAEIRCTNPVSYEPWGKISCVEDSISDQMNGGLT

SEQ ID NO: 200649 - protein, 38 aa, Artificial Sequence
  Description of Artificial Sequence: Synthetic polypeptide
DEAEISTTNPVATEQYGCVCSNWGEDHNAENSNSETQS

SEQ ID NO: 200650 - protein, 38 aa, Artificial Sequence
  Description of Artificial Sequence: Synthetic polypeptide
DEMEISTTNPVATEQYGQCVCSNWGEHNAEFFNSDFQS

SEQ ID NO: 200651 - protein, 35 aa, Artificial Sequence
  Description of Artificial Sequence: Synthetic polypeptide
DEAEIRCTNPVSYEPWGKISCMPDSFSDQMNGGNT

SEQ ID NO: 200652 - protein, 38 aa, Artificial Sequence
  Description of Artificial Sequence: Synthetic polypeptide
DEMEIRTTNPVATCQYGCVCSNWGEDHNTEYFNSDNQS

SEQ ID NO: 200653 - protein, 38 aa, Artificial Sequence
  Description of Artificial Sequence: Synthetic polypeptide
DEEEISTTNPVATEGYGCVCSMWGEDHNAENFNSDTQA

SEQ ID NO: 200654 - protein, 38 aa, Artificial Sequence
  Description of Artificial Sequence: Synthetic polypeptide
DEEAIRCTNPVATEQYGQCVCSNWGEHNQEFFNSDNQS

SEQ ID NO: 200655 - protein, 38 aa, Artificial Sequence
  Description of Artificial Sequence: Synthetic polypeptide
DEAEISTTNPVATEQYGCVCSNWGEDHNAENFNSDTQA

SEQ ID NO: 200656 - protein, 38 aa, Artificial Sequence
  Description of Artificial Sequence: Synthetic polypeptide
AEEEISTTNPVATEQYGQCVCSNSGEHNAEFFGSDTQS

SEQ ID NO: 200657 - protein, 37 aa, Artificial Sequence
  Description of Artificial Sequence: Synthetic polypeptide
TEIATEIATTNPVAYEQWGSVCFTVEDNDRRPDGHQG

SEQ ID NO: 200658 - protein, 38 aa, Artificial Sequence
  Description of Artificial Sequence: Synthetic polypeptide
DQGEIRTTNPVATEQYGVCVTSYHVSEPSTDEGLESDM

SEQ ID NO: 200659 - protein, 38 aa, Artificial Sequence
  Description of Artificial Sequence: Synthetic polypeptide
DEECISTTNPVATEQYGCVCSNWGEDDNTENFNSEFQG

SEQ ID NO: 200660 - protein, 35 aa, Artificial Sequence
  Description of Artificial Sequence: Synthetic polypeptide
DEAEIRCTNPVSYEPWGKISCMEDSISDQMPGGNL

SEQ ID NO: 200661 - protein, 37 aa, Artificial Sequence
  Description of Artificial Sequence: Synthetic polypeptide
DEMEICTTNPVATEQYGCACGCHACDGPTVEFEGNSI

SEQ ID NO: 200662 - protein, 36 aa, Artificial Sequence
  Description of Artificial Sequence: Synthetic polypeptide
AEASEIATTNPVAYEQWGSVYGGWDDQPQGNKNGQP

SEQ ID NO: 200663 - protein, 38 aa, Artificial Sequence
  Description of Artificial Sequence: Synthetic polypeptide
AEEEISTTNPVATEQYGQCVCSNSGEHNAENFGSDTQS

SEQ ID NO: 200664 - protein, 38 aa, Artificial Sequence
  Description of Artificial Sequence: Synthetic polypeptide
DEECISTTNPVATEQYGCVCSNWGEDDNAENFNSENQS

SEQ ID NO: 200665 - protein, 38 aa, Artificial Sequence
  Description of Artificial Sequence: Synthetic polypeptide
DEAEISTTNPVATEQYGCVCSNWGEDHNAENFNSDTQL

SEQ ID NO: 200666 - protein, 38 aa, Artificial Sequence
  Description of Artificial Sequence: Synthetic polypeptide
DEHNEIATTNPVAYEQWGEVCSTPNQGNHGETGGDGNT

SEQ ID NO: 200667 - protein, 37 aa, Artificial Sequence
  Description of Artificial Sequence: Synthetic polypeptide
DEECISTTNPVATEQYGCVCQNWGEHNDENFNSDTQA

SEQ ID NO: 200668 - protein, 36 aa, Artificial Sequence
  Description of Artificial Sequence: Synthetic polypeptide
DEEVIACTNPVAYEQYGSCAAAGGNHGNAEGNGSQN

SEQ ID NO: 200669 - protein, 37 aa, Artificial Sequence
  Description of Artificial Sequence: Synthetic polypeptide
DEMEIVTTNPVATEQYGCVCSNWGEDNEEFFISDTQS

SEQ ID NO: 200670 - protein, 40 aa, Artificial Sequence
  Description of Artificial Sequence: Synthetic polypeptide
VENEIRTTNPVATEFYGVVNTTDQGGNNLLREFDEGNEGA

SEQ ID NO: 200671 - protein, 39 aa, Artificial Sequence
  Description of Artificial Sequence: Synthetic polypeptide
DEECIRTTNPVATEQYGQCVCSNWGEDHNAENFNSDNQA

SEQ ID NO: 200672 - protein, 39 aa, Artificial Sequence
  Description of Artificial Sequence: Synthetic polypeptide
AEEEISTTNPVATEQYGQCVCSMWGEDHNAENFGSDNQA

SEQ ID NO: 200673 - protein, 39 aa, Artificial Sequence
  Description of Artificial Sequence: Synthetic polypeptide
DEECIRTTNPVATEQYGQCVCSNWGEDHNAENFNSDNQG

SEQ ID NO: 200674 - protein, 39 aa, Artificial Sequence
  Description of Artificial Sequence: Synthetic polypeptide
DEECIRTTNPVATEQYGQCVCSNWGEDHNAENFNSDNQS

SEQ ID NO: 200675 - protein, 38 aa, Artificial Sequence
  Description of Artificial Sequence: Synthetic polypeptide
DEAEISTTNPVATEQYGCVCSNWGEDHNAEYFNSEFQS

SEQ ID NO: 200676 - protein, 37 aa, Artificial Sequence
  Description of Artificial Sequence: Synthetic polypeptide
NDEEIRTTNPVAYEQYGCVCSNWGEDNAENFNSDTQS

SEQ ID NO: 200677 - protein, 38 aa, Artificial Sequence
  Description of Artificial Sequence: Synthetic polypeptide
DEEEIRTTNPVAYEGYGQCVCSNWGEHNQENFNSETQA

SEQ ID NO: 200678 - protein, 36 aa, Artificial Sequence
  Description of Artificial Sequence: Synthetic polypeptide
DETAEIATTNPVAYEQWGSVCAMANWDNASGESDSW

SEQ ID NO: 200679 - protein, 35 aa, Artificial Sequence
  Description of Artificial Sequence: Synthetic polypeptide
DESAIGTTNPVATEQYGCLCTATSGSPVEFETDKQ

SEQ ID NO: 200680 - protein, 38 aa, Artificial Sequence
  Description of Artificial Sequence: Synthetic polypeptide
DEEEIRTTNPVAYEGYGQCVCSNWGEHNQENFNSDTQS

SEQ ID NO: 200681 - protein, 38 aa, Artificial Sequence
  Description of Artificial Sequence: Synthetic polypeptide
DEEEIRTTNPVAYEGYGQCVCSNWGEHNIENFNSDNQA

SEQ ID NO: 200682 - protein, 37 aa, Artificial Sequence
  Description of Artificial Sequence: Synthetic polypeptide
CDEEISTTNPVATEQYGCVCSWGEDHNAEHFNSDTQS

SEQ ID NO: 200683 - protein, 38 aa, Artificial Sequence
  Description of Artificial Sequence: Synthetic polypeptide
DDAEISTTNPVATEQYGQCVCSWGEDHNQENFGSDNQG

SEQ ID NO: 200684 - protein, 38 aa, Artificial Sequence
  Description of Artificial Sequence: Synthetic polypeptide
DEEEIACTNPVATEQYGCSSAANTHAPEAGGNQMENTN

SEQ ID NO: 200685 - protein, 38 aa, Artificial Sequence
  Description of Artificial Sequence: Synthetic polypeptide
DEEEISTTNPVATEGYGCVCSDWGEDHNQENFNSDNQS

SEQ ID NO: 200686 - protein, 33 aa, Artificial Sequence
  Description of Artificial Sequence: Synthetic polypeptide
TENEIATTNPVAYEQWGCLNCFEGDQHHLNGSK

SEQ ID NO: 200687 - protein, 38 aa, Artificial Sequence
  Description of Artificial Sequence: Synthetic polypeptide
DEECISTTNPVATEQYGCVCSNWGEDHNAEGFNSDTQS

SEQ ID NO: 200688 - protein, 38 aa, Artificial Sequence
  Description of Artificial Sequence: Synthetic polypeptide
DEMEIVTTNPVATEQYGCVCSNWGEDPNIEFFNSDNQS

SEQ ID NO: 200689 - protein, 37 aa, Artificial Sequence
  Description of Artificial Sequence: Synthetic polypeptide
DEEEISTTNPVATEGYGCVCQWGEDHNQENFNSENQP

SEQ ID NO: 200690 - protein, 36 aa, Artificial Sequence
  Description of Artificial Sequence: Synthetic polypeptide
DEDEIATTNPVATEQWGCCAGTGPHPGFNHPDDMNN

SEQ ID NO: 200691 - protein, 38 aa, Artificial Sequence
  Description of Artificial Sequence: Synthetic polypeptide
CEEEIACTNPVATEQWGHVSNANTGNPPENQGGGMLQM

SEQ ID NO: 200692 - protein, 38 aa, Artificial Sequence
  Description of Artificial Sequence: Synthetic polypeptide
CEEEISTTNPVATEQYGQCVCSNWGEHNQENFFSDNQA

SEQ ID NO: 200693 - protein, 39 aa, Artificial Sequence
  Description of Artificial Sequence: Synthetic polypeptide
DEEEIRTTNPVAYEGYGQCVCSNWMEDHNQESFGSQNQS

SEQ ID NO: 200694 - protein, 38 aa, Artificial Sequence
  Description of Artificial Sequence: Synthetic polypeptide
DEEEISTTNPVATEGYGCVCSNSGEDHNQENFGSDTQS

SEQ ID NO: 200695 - protein, 37 aa, Artificial Sequence
  Description of Artificial Sequence: Synthetic polypeptide
CDEEISTTNPVATEQYGCVCSWGEDHNAENFNSDTQD

SEQ ID NO: 200696 - protein, 37 aa, Artificial Sequence
  Description of Artificial Sequence: Synthetic polypeptide
NDEEIRTTNPVATEQYGQCVCSNWGEDNANFNSDTQS

SEQ ID NO: 200697 - protein, 39 aa, Artificial Sequence
  Description of Artificial Sequence: Synthetic polypeptide
DDEEIRTTNPVATEFYGCVNFNMDGQDLDQGGGGGETGT

SEQ ID NO: 200698 - protein, 38 aa, Artificial Sequence
  Description of Artificial Sequence: Synthetic polypeptide
NDEEIRTTNPVATEQYGQCVCSNWGEDDNQNFGSDTQS

SEQ ID NO: 200699 - protein, 39 aa, Artificial Sequence
  Description of Artificial Sequence: Synthetic polypeptide
DEEEIATTNPVATEAYGKVVPHPTAPAGSQQPNTDDYRY

SEQ ID NO: 200700 - protein, 37 aa, Artificial Sequence
  Description of Artificial Sequence: Synthetic polypeptide
DEAEIRTTNPVATEQYGHIWNNTHEAFSNPSELETQI

SEQ ID NO: 200701 - protein, 38 aa, Artificial Sequence
  Description of Artificial Sequence: Synthetic polypeptide
DEAEIRCTNPVATEQYGQCVCSNWGEHNEENFNSDTQS

SEQ ID NO: 200702 - protein, 39 aa, Artificial Sequence
  Description of Artificial Sequence: Synthetic polypeptide
DEEEIRTTNPVAYEGYGICVTSTWGEDHNAENFGSDPQA

SEQ ID NO: 200703 - protein, 38 aa, Artificial Sequence
  Description of Artificial Sequence: Synthetic polypeptide
DEEEIRTTNPVAYEGYGQCVTSTWGAHNAEHFISDPQS

SEQ ID NO: 200704 - protein, 38 aa, Artificial Sequence
  Description of Artificial Sequence: Synthetic polypeptide
DEAEISTTNPVATEQYGCVCSNWGEDHNAENFNSDNQA

SEQ ID NO: 200705 - protein, 38 aa, Artificial Sequence
  Description of Artificial Sequence: Synthetic polypeptide
DENEIRTTNPVATEQYGCVGDTDAENGSDETIEESQVE

SEQ ID NO: 200706 - protein, 38 aa, Artificial Sequence
  Description of Artificial Sequence: Synthetic polypeptide
DEHNEIATTNPVAYEQWGEVCSTGNGGNHGEAGGDGNN

SEQ ID NO: 200707 - protein, 37 aa, Artificial Sequence
  Description of Artificial Sequence: Synthetic polypeptide
CDEEISTTNPVATEQYGCVCSWGEDHNAENFGSDTQS

SEQ ID NO: 200708 - protein, 35 aa, Artificial Sequence
  Description of Artificial Sequence: Synthetic polypeptide
DENEIRTTNPVATECWGATTWANAEIEAEPAGPYI

SEQ ID NO: 200709 - protein, 33 aa, Artificial Sequence
  Description of Artificial Sequence: Synthetic polypeptide
QEPEIAATNPVGTEHYGVCASTLEVLVGEPIIY

SEQ ID NO: 200710 - protein, 38 aa, Artificial Sequence
  Description of Artificial Sequence: Synthetic polypeptide
DEEEISTTNPVATEEYGQCVCSWGEDHNQESFNSDTQS

SEQ ID NO: 200711 - protein, 38 aa, Artificial Sequence
  Description of Artificial Sequence: Synthetic polypeptide
DEMEISTTNPVATEQYGQCVCSNWGEHNAENFNSDTQS

SEQ ID NO: 200712 - protein, 36 aa, Artificial Sequence
  Description of Artificial Sequence: Synthetic polypeptide
VEDEIATTNPVAYEQWGSVCSMANPALNAHDDLTAM

SEQ ID NO: 200713 - protein, 39 aa, Artificial Sequence
  Description of Artificial Sequence: Synthetic polypeptide
DDEEIKTTNPVATEQYGAVNMTNTINFEEDQEEGGQQTI

SEQ ID NO: 200714 - protein, 38 aa, Artificial Sequence
  Description of Artificial Sequence: Synthetic polypeptide
DEAEISTTNPVATEQYGCVCSNWGELHNAENFNSDNQS

SEQ ID NO: 200715 - protein, 37 aa, Artificial Sequence
  Description of Artificial Sequence: Synthetic polypeptide
CEEEISTTNPVATEQYGCVCPMWMEHNEENFNSDTQA

SEQ ID NO: 200716 - protein, 34 aa, Artificial Sequence
  Description of Artificial Sequence: Synthetic polypeptide
DSEDIATTNPVATEQWGGCVAGEGEHATPAVGPL

SEQ ID NO: 200717 - protein, 39 aa, Artificial Sequence
  Description of Artificial Sequence: Synthetic polypeptide
DEECIRTTNPVATEQYGQCVCSNWGEDHNAENFNSENQA

SEQ ID NO: 200718 - protein, 35 aa, Artificial Sequence
  Description of Artificial Sequence: Synthetic polypeptide
DSAEIATTNPVAYEEWGSVTQQAMHSMNASGNEKK

SEQ ID NO: 200719 - protein, 36 aa, Artificial Sequence
  Description of Artificial Sequence: Synthetic polypeptide
NEAEIATTNPVAYEQWGMTSTTGNPMNQGNHGEGGI

SEQ ID NO: 200720 - protein, 38 aa, Artificial Sequence
  Description of Artificial Sequence: Synthetic polypeptide
DEEEISTTNPVATEGYGCVCSNWEEDHNAENFNSDNQA

SEQ ID NO: 200721 - protein, 39 aa, Artificial Sequence
  Description of Artificial Sequence: Synthetic polypeptide
DEEEIRTTNPVATEQYGFNWNYLGTSDESEGRYQENKDE

SEQ ID NO: 200722 - protein, 37 aa, Artificial Sequence
  Description of Artificial Sequence: Synthetic polypeptide
DEAEIRTTNPVATEQYGWHIWNNVTHEFSNPSEETQI

SEQ ID NO: 200723 - protein, 36 aa, Artificial Sequence
  Description of Artificial Sequence: Synthetic polypeptide
DEECISTTNPCATEQYGCVCPWEEHNQENFGSDTQA

SEQ ID NO: 200724 - protein, 35 aa, Artificial Sequence
  Description of Artificial Sequence: Synthetic polypeptide
SEAEIATTNPVAYEAWGVVWPGPNNENDGPQGGSR

SEQ ID NO: 200725 - protein, 35 aa, Artificial Sequence
  Description of Artificial Sequence: Synthetic polypeptide
TEGEIRTTNPVATEQYGCYTWCDQDIADTDDVSQI

SEQ ID NO: 200726 - protein, 40 aa, Artificial Sequence
  Description of Artificial Sequence: Synthetic polypeptide
DEEEIRTTNPVATEQYGTTYAISPRATPVHVVSPFQNERD

SEQ ID NO: 200727 - protein, 38 aa, Artificial Sequence
  Description of Artificial Sequence: Synthetic polypeptide
CEEEISTTNPVATEQYGCVCSMSGEDHNQEYFGSDTQS

SEQ ID NO: 200728 - protein, 36 aa, Artificial Sequence
  Description of Artificial Sequence: Synthetic polypeptide
DETAEIACTNPVAYEQWGSVCAMANWDNASGESDRP

SEQ ID NO: 200729 - protein, 39 aa, Artificial Sequence
  Description of Artificial Sequence: Synthetic polypeptide
DEEAIRTTNPVATEQYGQCVCSMWGEDHEAENFGSDNQA

SEQ ID NO: 200730 - protein, 37 aa, Artificial Sequence
  Description of Artificial Sequence: Synthetic polypeptide
DENEISTTNPVAYEQYGSCPMPIMLWPENRSISQLTS

SEQ ID NO: 200731 - protein, 38 aa, Artificial Sequence
  Description of Artificial Sequence: Synthetic polypeptide
DEEEISTTNPVATEGYGCVCSNWEEDHNAENFNSDTQS

SEQ ID NO: 200732 - protein, 38 aa, Artificial Sequence
  Description of Artificial Sequence: Synthetic polypeptide
CEEEISTTNPVATEQYGCQVCSNWGEHNAENFNSDTQA

SEQ ID NO: 200733 - protein, 34 aa, Artificial Sequence
  Description of Artificial Sequence: Synthetic polypeptide
DEEEIASVNPIATECYGVTVANAENWAEPKGPYQ

SEQ ID NO: 200734 - protein, 39 aa, Artificial Sequence
  Description of Artificial Sequence: Synthetic polypeptide
DEEEISTTNPVATEEYGQCVCSNWGEDTNAENFNSDTQA

SEQ ID NO: 200735 - protein, 38 aa, Artificial Sequence
  Description of Artificial Sequence: Synthetic polypeptide
CEEEISTTNPVATEQYGCVCSMWEEDHNAEGFGSDTQS

SEQ ID NO: 200736 - protein, 36 aa, Artificial Sequence
  Description of Artificial Sequence: Synthetic polypeptide
DSAEIATTNPVAYEMWGSVRQQQNMHSTNASGNEYK

SEQ ID NO: 200737 - protein, 38 aa, Artificial Sequence
  Description of Artificial Sequence: Synthetic polypeptide
DEAEISTTNPVATEQYGCVCSNWGEDHNQENFNSQTQA

SEQ ID NO: 200738 - protein, 39 aa, Artificial Sequence
  Description of Artificial Sequence: Synthetic polypeptide
DEECISTTNPVATEQYGCAVCSNWGEDHNQENFGSDNQA

SEQ ID NO: 200739 - protein, 35 aa, Artificial Sequence
  Description of Artificial Sequence: Synthetic polypeptide
VEDEIATTNPVAYEQWGTFACAATAGELPDSGPNK

SEQ ID NO: 200740 - protein, 37 aa, Artificial Sequence
  Description of Artificial Sequence: Synthetic polypeptide
CEEEISTTNPVATEQYGCVCPNWGEHNAENFNSDNQS

SEQ ID NO: 200741 - protein, 37 aa, Artificial Sequence
  Description of Artificial Sequence: Synthetic polypeptide
DDEEISTTNPVATEGYGCVCSNWGEHNAENFNSDTQS

SEQ ID NO: 200742 - protein, 38 aa, Artificial Sequence
  Description of Artificial Sequence: Synthetic polypeptide
DEEEISTTNPVATEEYGQCVCSNWEEHNAENFNSDTQS

SEQ ID NO: 200743 - protein, 38 aa, Artificial Sequence
  Description of Artificial Sequence: Synthetic polypeptide
DEEEISTTNPVATEEYGQCVCSNWGEHNIENFNSDTQL

SEQ ID NO: 200744 - protein, 37 aa, Artificial Sequence
  Description of Artificial Sequence: Synthetic polypeptide
DEAEISTTNPVATEQYGCVCSNWEEHNQENFISDTQS

SEQ ID NO: 200745 - protein, 37 aa, Artificial Sequence
  Description of Artificial Sequence: Synthetic polypeptide
DETEIACTNPVATAQWGSVSVSGNPGENTRGVIEEME

SEQ ID NO: 200746 - protein, 38 aa, Artificial Sequence
  Description of Artificial Sequence: Synthetic polypeptide
DEECISTTNPVATEQYGCVCSNWGEDHNAENFNSETQA

SEQ ID NO: 200747 - protein, 39 aa, Artificial Sequence
  Description of Artificial Sequence: Synthetic polypeptide
DEECIRTTNPVATEQYGQCVCSNWGEDHNQESFNSDNQA

SEQ ID NO: 200748 - protein, 37 aa, Artificial Sequence
  Description of Artificial Sequence: Synthetic polypeptide
DDEEISTTNPVATEGYGCVCSNWGEHNAENFNSDTQA

SEQ ID NO: 200749 - protein, 37 aa, Artificial Sequence
  Description of Artificial Sequence: Synthetic polypeptide
CEEEISTTNPVATEGYGCVCSWGEDHNAENFNSDPQS

SEQ ID NO: 200750 - protein, 38 aa, Artificial Sequence
  Description of Artificial Sequence: Synthetic polypeptide
DEAEISTTNPVATEQYGCVCSNWGEDHNQENFNSDTQS

SEQ ID NO: 200751 - protein, 38 aa, Artificial Sequence
  Description of Artificial Sequence: Synthetic polypeptide
DEECISTTNPVATEQYGCVCSNWEEDHNQENFGSDTQA

SEQ ID NO: 200752 - protein, 38 aa, Artificial Sequence
  Description of Artificial Sequence: Synthetic polypeptide
AEEEISTTNPVATEQYGQCVCSNSGEHNQESSNSDNQE

SEQ ID NO: 200753 - protein, 38 aa, Artificial Sequence
  Description of Artificial Sequence: Synthetic polypeptide
DEESIRTTNPVAYEPYYQGVNSNTEIDLLQPRSIEKHA

SEQ ID NO: 200754 - protein, 37 aa, Artificial Sequence
  Description of Artificial Sequence: Synthetic polypeptide
NDAEIRTTNPVATEQYGCVCSNWGEHNAENFNSDTQS

SEQ ID NO: 200755 - protein, 39 aa, Artificial Sequence
  Description of Artificial Sequence: Synthetic polypeptide
DEECIRTTNPVATEQYGQCVCSNWGEDHNQENFGSETQG

SEQ ID NO: 200756 - protein, 38 aa, Artificial Sequence
  Description of Artificial Sequence: Synthetic polypeptide
CEEEISTTNPVATEQYGCVCSNSGEDPNQENFGSDTQS

SEQ ID NO: 200757 - protein, 38 aa, Artificial Sequence
  Description of Artificial Sequence: Synthetic polypeptide
DEEEISTTNPVATEEYGQCVCSNSGEHNQENFGSDTQS

SEQ ID NO: 200758 - protein, 36 aa, Artificial Sequence
  Description of Artificial Sequence: Synthetic polypeptide
AESEIATTNPVAYEQWGSVYGGWDDQPGQGNGTGNW

SEQ ID NO: 200759 - protein, 36 aa, Artificial Sequence
  Description of Artificial Sequence: Synthetic polypeptide
NEAAEIATTNPVAYEQWGSCATGGLNDERNMDRGEG

SEQ ID NO: 200760 - protein, 39 aa, Artificial Sequence
  Description of Artificial Sequence: Synthetic polypeptide
DEEEISTTNPVATEGYGQCVCSNWGEDHNTEAFNSENQA

SEQ ID NO: 200761 - protein, 35 aa, Artificial Sequence
  Description of Artificial Sequence: Synthetic polypeptide
AESEIACTNPVAYEGYGEACACENLSQETGVGGDD

SEQ ID NO: 200762 - protein, 34 aa, Artificial Sequence
  Description of Artificial Sequence: Synthetic polypeptide
QENEIATTNPVAYAPWGNTVPAGEGHLQHMNMKK

SEQ ID NO: 200763 - protein, 35 aa, Artificial Sequence
  Description of Artificial Sequence: Synthetic polypeptide
DETEIRTTNPIATECWGATTWANAEDWAEPKGHYI

SEQ ID NO: 200764 - protein, 36 aa, Artificial Sequence
  Description of Artificial Sequence: Synthetic polypeptide
DEDEIATTNPVAYAPWGTACAATAGELPDSAGNPRH

SEQ ID NO: 200765 - protein, 35 aa, Artificial Sequence
  Description of Artificial Sequence: Synthetic polypeptide
DETEIRTTNPIATECWGATTWANAEDWAEPKGIYI

SEQ ID NO: 200766 - protein, 37 aa, Artificial Sequence
  Description of Artificial Sequence: Synthetic polypeptide
CEDEIACTNPVAYEQYGSACATNPELGQEHQDDQTAH

SEQ ID NO: 200767 - protein, 35 aa, Artificial Sequence
  Description of Artificial Sequence: Synthetic polypeptide
DETEIRTTNPIATECWGATTWANAEDWAEPKGPYA

SEQ ID NO: 200768 - protein, 35 aa, Artificial Sequence
  Description of Artificial Sequence: Synthetic polypeptide
DETEIRTTNPIATECWGATTWANAEDWAEPKGGYI

SEQ ID NO: 200769 - protein, 38 aa, Artificial Sequence
  Description of Artificial Sequence: Synthetic polypeptide
DEDEIATTNPVAYEQWGSVCSAANPPAPEAHGGDLPAM

SEQ ID NO: 200770 - protein, 35 aa, Artificial Sequence
  Description of Artificial Sequence: Synthetic polypeptide
DETEIRTTNPIATECWGATTWANAEDWAEPKGDYI

SEQ ID NO: 200771 - protein, 33 aa, Artificial Sequence
  Description of Artificial Sequence: Synthetic polypeptide
DETEIASTNPIATEGWGATTAAATWQEPKGPYI

SEQ ID NO: 200772 - protein, 37 aa, Artificial Sequence
  Description of Artificial Sequence: Synthetic polypeptide
CEDEIACTNPVAYEQWGSICSVANPALQEHGIDITAM

SEQ ID NO: 200773 - protein, 38 aa, Artificial Sequence
  Description of Artificial Sequence: Synthetic polypeptide
VEDEIATTNPVAYEQYGSVPAIANPDETADAGMNNDEH

SEQ ID NO: 200774 - protein, 34 aa, Artificial Sequence
  Description of Artificial Sequence: Synthetic polypeptide
DETEIASTNPIATEGYGATTWANAEDWAEPKGPI

SEQ ID NO: 200775 - protein, 35 aa, Artificial Sequence
  Description of Artificial Sequence: Synthetic polypeptide
DETEIRTTNPIATECWGATTWANAEDWAEPKGEYI

SEQ ID NO: 200776 - protein, 39 aa, Artificial Sequence
  Description of Artificial Sequence: Synthetic polypeptide
DEEEISTTNPVATEGYGQCVCSNWGEDHNQENFNSDTQG

SEQ ID NO: 200777 - protein, 39 aa, Artificial Sequence
  Description of Artificial Sequence: Synthetic polypeptide
DEEEIGTTNPVAYEQYGQCVCSNWGEDDNAENFNSETQA

SEQ ID NO: 200778 - protein, 39 aa, Artificial Sequence
  Description of Artificial Sequence: Synthetic polypeptide
DEEEIRTTNPVAYEQYGQCVCSNWGEDHNQENFISDTQS

SEQ ID NO: 200779 - protein, 35 aa, Artificial Sequence
  Description of Artificial Sequence: Synthetic polypeptide
DEDEIATTNPVAYASWGCVAAANHDTAQAEQNVHS

SEQ ID NO: 200780 - protein, 38 aa, Artificial Sequence
  Description of Artificial Sequence: Synthetic polypeptide
DEMEIGTTNPVATEQYGQCVCSNWGEPNAEFFSSDTQA

SEQ ID NO: 200781 - protein, 35 aa, Artificial Sequence
  Description of Artificial Sequence: Synthetic polypeptide
DETEIRTTNPIATECWGATTWANAEDWAEPKGFYI

SEQ ID NO: 200782 - protein, 37 aa, Artificial Sequence
  Description of Artificial Sequence: Synthetic polypeptide
VEDEIACTNPVAYEQWGSVCSANPALGQEHMIDITAM

SEQ ID NO: 200783 - protein, 35 aa, Artificial Sequence
  Description of Artificial Sequence: Synthetic polypeptide
DETEIRTTNPIATECWGATTWANAEDWANPKGPYI

SEQ ID NO: 200784 - protein, 37 aa, Artificial Sequence
  Description of Artificial Sequence: Synthetic polypeptide
CEGEIACTNPVATEQYGSVCAAIEGLDAGTPGDEDAY

SEQ ID NO: 200785 - protein, 35 aa, Artificial Sequence
  Description of Artificial Sequence: Synthetic polypeptide
DETEIRTTNPIATECWGATTWANAEDWAMPKGPYI

SEQ ID NO: 200786 - protein, 37 aa, Artificial Sequence
  Description of Artificial Sequence: Synthetic polypeptide
CEDEIACTNPVATEQYGSACAANPAEEAGAHADNDQP

SEQ ID NO: 200787 - protein, 37 aa, Artificial Sequence
  Description of Artificial Sequence: Synthetic polypeptide
CEDEIACTNPVAYEQWGSVCSAANNPANAHGIDNEAM

SEQ ID NO: 200788 - protein, 35 aa, Artificial Sequence
  Description of Artificial Sequence: Synthetic polypeptide
DETEIRTTNPIATECWGATTWANAEDWAIPKGPYI

SEQ ID NO: 200789 - protein, 35 aa, Artificial Sequence
  Description of Artificial Sequence: Synthetic polypeptide
DETEIRTTNPIATECWGATTWANAEDWAEPKGKWI

SEQ ID NO: 200790 - protein, 34 aa, Artificial Sequence
  Description of Artificial Sequence: Synthetic polypeptide
DETEIATTNPIATECWGATTWANAEDWQPKEPYI

SEQ ID NO: 200791 - protein, 35 aa, Artificial Sequence
  Description of Artificial Sequence: Synthetic polypeptide
DETEIRTTNPIATECWGATTWANAEDWAEPKGPDI

SEQ ID NO: 200792 - protein, 35 aa, Artificial Sequence
  Description of Artificial Sequence: Synthetic polypeptide
DETEIRTTNPIATECWGATTWANAEDWAEPKGPEI

SEQ ID NO: 200793 - protein, 35 aa, Artificial Sequence
  Description of Artificial Sequence: Synthetic polypeptide
TTAEIATTNPVAYECWGICSGLGNNDDRQEQGNQV

SEQ ID NO: 200794 - protein, 34 aa, Artificial Sequence
  Description of Artificial Sequence: Synthetic polypeptide
DETEIRCTNPIATECWGATWANAEDWAEPKGPYI

SEQ ID NO: 200795 - protein, 35 aa, Artificial Sequence
  Description of Artificial Sequence: Synthetic polypeptide
DETEIRTTNPIATECWGATTWANAEDWAETVGPYI

SEQ ID NO: 200796 - protein, 38 aa, Artificial Sequence
  Description of Artificial Sequence: Synthetic polypeptide
MEQEIRTTNPVATEQYGSIFNWCCPDDGESHEGQGIKW

SEQ ID NO: 200797 - protein, 36 aa, Artificial Sequence
  Description of Artificial Sequence: Synthetic polypeptide
DENCISTTNPVATEQWGCVCSSGEENAEYSISDTAS

SEQ ID NO: 200798 - protein, 35 aa, Artificial Sequence
  Description of Artificial Sequence: Synthetic polypeptide
DETEIRTTNPIATECWGATTWANAEDWAEVKGPYI

SEQ ID NO: 200799 - protein, 35 aa, Artificial Sequence
  Description of Artificial Sequence: Synthetic polypeptide
DETEIRTTNPIATECWGATTWANAEDWAEPKGPFI

SEQ ID NO: 200800 - protein, 35 aa, Artificial Sequence
  Description of Artificial Sequence: Synthetic polypeptide
DDSEVACTNPVSTEGYGNVCYNTIDQSRHGQQHKA

SEQ ID NO: 200801 - protein, 38 aa, Artificial Sequence
  Description of Artificial Sequence: Synthetic polypeptide
VEDEIATTNPVAYEQWGSVSGGEYGNGGNMRNKMEVAQ

SEQ ID NO: 200802 - protein, 35 aa, Artificial Sequence
  Description of Artificial Sequence: Synthetic polypeptide
DETEIATTNPIATECWGATTWANAEDWQEPKGPYI

SEQ ID NO: 200803 - protein, 35 aa, Artificial Sequence
  Description of Artificial Sequence: Synthetic polypeptide
DETEIRTTNPIATECWGATTWANAEDWAETKGPYI

SEQ ID NO: 200804 - protein, 37 aa, Artificial Sequence
  Description of Artificial Sequence: Synthetic polypeptide
DETEIASTNPVAYEQYGSACSVAPHLNNEAPIGEAMN

SEQ ID NO: 200805 - protein, 35 aa, Artificial Sequence
  Description of Artificial Sequence: Synthetic polypeptide
DETEIRTTNPIATECWGATTWANAEDWAESQGPYI

SEQ ID NO: 200806 - protein, 34 aa, Artificial Sequence
  Description of Artificial Sequence: Synthetic polypeptide
DETEIATTNPIATECWGATTWANAEDWAPKGPYI

SEQ ID NO: 200807 - protein, 35 aa, Artificial Sequence
  Description of Artificial Sequence: Synthetic polypeptide
DETEIRTTNPIATECWGATTWANAEDWAESKGPYI

SEQ ID NO: 200808 - protein, 38 aa, Artificial Sequence
  Description of Artificial Sequence: Synthetic polypeptide
DETEIACTNPVATEQYGSACSPAGEGGVGAMLADQTNH

SEQ ID NO: 200809 - protein, 35 aa, Artificial Sequence
  Description of Artificial Sequence: Synthetic polypeptide
DETEIRTTNPIATECWGATTWANAEDWAEPKGPCI

SEQ ID NO: 200810 - protein, 35 aa, Artificial Sequence
  Description of Artificial Sequence: Synthetic polypeptide
DETEIRTTNPIATECWGATTWANAEDWAEPKGPAI

SEQ ID NO: 200811 - protein, 34 aa, Artificial Sequence
  Description of Artificial Sequence: Synthetic polypeptide
DEQEIATTNPIATEQWGATTWAAADWAEPKGPYI

SEQ ID NO: 200812 - protein, 39 aa, Artificial Sequence
  Description of Artificial Sequence: Synthetic polypeptide
DDEEIRTTNPVATEGYGQCVCSNWGEDHNAENFNSDTQS

SEQ ID NO: 200813 - protein, 35 aa, Artificial Sequence
  Description of Artificial Sequence: Synthetic polypeptide
DDSEVASTNPVSYEGYGNTVACNGEPSQSRTGGQR

SEQ ID NO: 200814 - protein, 35 aa, Artificial Sequence
  Description of Artificial Sequence: Synthetic polypeptide
DETEIRTTNPIATECWGATTWANAEDWAKPKGPYI

SEQ ID NO: 200815 - protein, 35 aa, Artificial Sequence
  Description of Artificial Sequence: Synthetic polypeptide
DETEIRTTNPIATECWGATTWANAEDWAEPKGKYI

SEQ ID NO: 200816 - protein, 37 aa, Artificial Sequence
  Description of Artificial Sequence: Synthetic polypeptide
DETAEIATTNPVAYERWGSAYITDNMNQQQDQHGDEN

SEQ ID NO: 200817 - protein, 35 aa, Artificial Sequence
  Description of Artificial Sequence: Synthetic polypeptide
DETEIRTTNPIATECWGATTWANAEDWAHPKGPYI

SEQ ID NO: 200818 - protein, 38 aa, Artificial Sequence
  Description of Artificial Sequence: Synthetic polypeptide
DENEITGVTNPVATEQYGSVTCWLMLEEIESEPEGQSI

SEQ ID NO: 200819 - protein, 35 aa, Artificial Sequence
  Description of Artificial Sequence: Synthetic polypeptide
DETEIRTTNPIATECWGATTWANAEDWAEPKGLYI

SEQ ID NO: 200820 - protein, 38 aa, Artificial Sequence
  Description of Artificial Sequence: Synthetic polypeptide
DEEEISTTNPVATEGWGQCVCSNWGEHNAENFNSDNQA

SEQ ID NO: 200821 - protein, 35 aa, Artificial Sequence
  Description of Artificial Sequence: Synthetic polypeptide
DETEIRTTNPIATECWGATTWANAEDWAEPKGMYI

SEQ ID NO: 200822 - protein, 38 aa, Artificial Sequence
  Description of Artificial Sequence: Synthetic polypeptide
VEDEIACTNPVAYEQWGSVCSAANAPATNAHGGDNEAM

SEQ ID NO: 200823 - protein, 35 aa, Artificial Sequence
  Description of Artificial Sequence: Synthetic polypeptide
DETEIRCTNPIATECWGSTTWANAEDWAEPKGPYI

SEQ ID NO: 200824 - protein, 35 aa, Artificial Sequence
  Description of Artificial Sequence: Synthetic polypeptide
DETEIRTTNPIATECWGATTWANAEDWAGPKGPYI

SEQ ID NO: 200825 - protein, 35 aa, Artificial Sequence
  Description of Artificial Sequence: Synthetic polypeptide
DETEIRTTNPIATECWGATTWANAEDWAFPKGPCI

SEQ ID NO: 200826 - protein, 36 aa, Artificial Sequence
  Description of Artificial Sequence: Synthetic polypeptide
DETEIRTTNPIATECWGATTWANAEDWAEPKGNPYI

SEQ ID NO: 200827 - protein, 37 aa, Artificial Sequence
  Description of Artificial Sequence: Synthetic polypeptide
DEDEIATTNPVATEQWGCNCAGTPDHPGDNHPDDSNN

SEQ ID NO: 200828 - protein, 35 aa, Artificial Sequence
  Description of Artificial Sequence: Synthetic polypeptide
DETEIRTTNPIATECWGATTWANAEDWAEYKGPYI

SEQ ID NO: 200829 - protein, 35 aa, Artificial Sequence
  Description of Artificial Sequence: Synthetic polypeptide
DETEIRTTNPIATECWGATTWANAEDWAEYKGEYI

SEQ ID NO: 200830 - protein, 35 aa, Artificial Sequence
  Description of Artificial Sequence: Synthetic polypeptide
DETEIRTTNPIATECWGATTWANAEDWAEWKGPYI

SEQ ID NO: 200831 - protein, 36 aa, Artificial Sequence
  Description of Artificial Sequence: Synthetic polypeptide
DETEIRTTNPIATECWGATTWANAEDWAEPKGKPYR

SEQ ID NO: 200832 - protein, 35 aa, Artificial Sequence
  Description of Artificial Sequence: Synthetic polypeptide
DETEIRTTNPIATECWGATTWANAEDWAPPKGPYI

SEQ ID NO: 200833 - protein, 33 aa, Artificial Sequence
  Description of Artificial Sequence: Synthetic polypeptide
DEEEIATTNPIATECWGATWAAEDWAEPKEPYI

SEQ ID NO: 200834 - protein, 39 aa, Artificial Sequence
  Description of Artificial Sequence: Synthetic polypeptide
DEEEIGTTNPVAYEQYGQCVCSNWGEDHNAENFNSDTQA

SEQ ID NO: 200835 - protein, 35 aa, Artificial Sequence
  Description of Artificial Sequence: Synthetic polypeptide
DETEIRTTNPIATECWGATTWANAEDWAEPGGPYI

SEQ ID NO: 200836 - protein, 37 aa, Artificial Sequence
  Description of Artificial Sequence: Synthetic polypeptide
DETEIATTNPVAYYEPQWGSIATATGTGPPDQTEGDA

SEQ ID NO: 200837 - protein, 37 aa, Artificial Sequence
  Description of Artificial Sequence: Synthetic polypeptide
VEDEIATTNPVAYEQYGSVPAIANPIEADAGTGTDEH

SEQ ID NO: 200838 - protein, 35 aa, Artificial Sequence
  Description of Artificial Sequence: Synthetic polypeptide
DETEIRTTNPIATECWGATTWANAEDWDEPKGPYI

SEQ ID NO: 200839 - protein, 35 aa, Artificial Sequence
  Description of Artificial Sequence: Synthetic polypeptide
VEDEIACTNPVAYEQWGTNSAANNEPMTAGGANSL

SEQ ID NO: 200840 - protein, 35 aa, Artificial Sequence
  Description of Artificial Sequence: Synthetic polypeptide
DETEIRTTNPIATECWGATTWANAEDWAEPGPYIT

SEQ ID NO: 200841 - protein, 38 aa, Artificial Sequence
  Description of Artificial Sequence: Synthetic polypeptide
YEDEIRTTNPVATEFYGAVVPNGFGNGEDDTDQTTGIQ

SEQ ID NO: 200842 - protein, 38 aa, Artificial Sequence
  Description of Artificial Sequence: Synthetic polypeptide
YEDEIRTTNPAATEQYGVVVVAGNEDGEQEGGEGEQDL

SEQ ID NO: 200843 - protein, 35 aa, Artificial Sequence
  Description of Artificial Sequence: Synthetic polypeptide
DENCIATVNPVATECYGEVVCIDHQQDQERQMTPS

SEQ ID NO: 200844 - protein, 38 aa, Artificial Sequence
  Description of Artificial Sequence: Synthetic polypeptide
QAEEIATTNPVATEQYGCVAPGEGGHGPQESAEEGNKF

SEQ ID NO: 200845 - protein, 38 aa, Artificial Sequence
  Description of Artificial Sequence: Synthetic polypeptide
DEEEISCTNPVATEGYGQCVCSNWGEHNAENFNSDTQS

SEQ ID NO: 200846 - protein, 39 aa, Artificial Sequence
  Description of Artificial Sequence: Synthetic polypeptide
NEREIRTTNPVATEQYGQCVCGNWGEDDNQEYFNSDTQS

SEQ ID NO: 200847 - protein, 35 aa, Artificial Sequence
  Description of Artificial Sequence: Synthetic polypeptide
DETEIATTNPIATECWGATTWANNEDWAEPKGPYR

SEQ ID NO: 200848 - protein, 38 aa, Artificial Sequence
  Description of Artificial Sequence: Synthetic polypeptide
MEGEIRTTNPVATEQYGTITPKDVPLLNQEDWSQIVEF

SEQ ID NO: 200849 - protein, 35 aa, Artificial Sequence
  Description of Artificial Sequence: Synthetic polypeptide
DETEIRTTNPIATECWGATTWANAEDWCEPKGPYV

SEQ ID NO: 200850 - protein, 33 aa, Artificial Sequence
  Description of Artificial Sequence: Synthetic polypeptide
DETEIAPTNPIATECWGATTWAAEDLAPKGPYI

SEQ ID NO: 200851 - protein, 38 aa, Artificial Sequence
  Description of Artificial Sequence: Synthetic polypeptide
DEEEISCTNPVATEGYGQCVCSNWGEHNAENFNSETQM

SEQ ID NO: 200852 - protein, 39 aa, Artificial Sequence
  Description of Artificial Sequence: Synthetic polypeptide
DEEEIACTNPVATEQWGGCSNAANADNPHGPDDQGNNRM

SEQ ID NO: 200853 - protein, 34 aa, Artificial Sequence
  Description of Artificial Sequence: Synthetic polypeptide
DETEIAPTNPIATECWGATVWAAENWAEPKGPYI

SEQ ID NO: 200854 - protein, 35 aa, Artificial Sequence
  Description of Artificial Sequence: Synthetic polypeptide
DETEIRTTNPIATECWGATTWANAEDWAEPFGPYI

SEQ ID NO: 200855 - protein, 35 aa, Artificial Sequence
  Description of Artificial Sequence: Synthetic polypeptide
DETEIRTTNPIATECWGATTWANAEDWAEPHGPYI

SEQ ID NO: 200856 - protein, 39 aa, Artificial Sequence
  Description of Artificial Sequence: Synthetic polypeptide
DENEISTTNPVATEGYGVVDVGVGTGNVGQQEGEGEDTA

SEQ ID NO: 200857 - protein, 38 aa, Artificial Sequence
  Description of Artificial Sequence: Synthetic polypeptide
DEDEIACTNPVAYEQWGSVCSEANPALAQEHMIDITAM

SEQ ID NO: 200858 - protein, 32 aa, Artificial Sequence
  Description of Artificial Sequence: Synthetic polypeptide
QEGEIACTNPCSYEQWGITCYCNDQQDHGDTM

SEQ ID NO: 200859 - protein, 37 aa, Artificial Sequence
  Description of Artificial Sequence: Synthetic polypeptide
QAEEIATTNPVATESYGCVAPGEGGHGNESAEEGNKD

SEQ ID NO: 200860 - protein, 39 aa, Artificial Sequence
  Description of Artificial Sequence: Synthetic polypeptide
AEEEIRATNPVAYEQYGSTACAATNPQDTNNGMLMGSDV

SEQ ID NO: 200861 - protein, 37 aa, Artificial Sequence
  Description of Artificial Sequence: Synthetic polypeptide
YEDEIRTTNPVATEQWGCVTKSAMQDSEGSETLIEQS

SEQ ID NO: 200862 - protein, 35 aa, Artificial Sequence
  Description of Artificial Sequence: Synthetic polypeptide
DETEIRTTNPIATECWGATTWANAEDWGEPKGPYI

SEQ ID NO: 200863 - protein, 36 aa, Artificial Sequence
  Description of Artificial Sequence: Synthetic polypeptide
VEDEIATTNPVAYEQWGPCTAGNGLSNPDSQSGKMS

SEQ ID NO: 200864 - protein, 38 aa, Artificial Sequence
  Description of Artificial Sequence: Synthetic polypeptide
DENEISTTNPVATEIYGQCVCSNWGEDNAEYFNSDTQS

SEQ ID NO: 200865 - protein, 35 aa, Artificial Sequence
  Description of Artificial Sequence: Synthetic polypeptide
DETEIRTTNPIATECWGATTWANAEDWFEPKGPYI

SEQ ID NO: 200866 - protein, 35 aa, Artificial Sequence
  Description of Artificial Sequence: Synthetic polypeptide
DETEIRTTNPIATECWGATTWANAEDWAEPDGPYN

SEQ ID NO: 200867 - protein, 35 aa, Artificial Sequence
  Description of Artificial Sequence: Synthetic polypeptide
DETEIRTTNPIATECWGATTWANAEDWEETQGPII

SEQ ID NO: 200868 - protein, 38 aa, Artificial Sequence
  Description of Artificial Sequence: Synthetic polypeptide
TEEEISTTNPVAYENYGTVVQACTGYNGQQNKFGGQIE

SEQ ID NO: 200869 - protein, 35 aa, Artificial Sequence
  Description of Artificial Sequence: Synthetic polypeptide
DETEIRTTNPIATECWGATTWANAEDWEEPKGPYI

SEQ ID NO: 200870 - protein, 38 aa, Artificial Sequence
  Description of Artificial Sequence: Synthetic polypeptide
TEEEISTTNPVAYENYGVTVSACTGYEGQQNKFGGQEE

SEQ ID NO: 200871 - protein, 35 aa, Artificial Sequence
  Description of Artificial Sequence: Synthetic polypeptide
DETEIRTTNPIATECWGATTWANAEDWEEPKGPAI

SEQ ID NO: 200872 - protein, 35 aa, Artificial Sequence
  Description of Artificial Sequence: Synthetic polypeptide
DETEIRTTNPIATECWGATTWANAEDWAEPEGEYI

SEQ ID NO: 200873 - protein, 39 aa, Artificial Sequence
  Description of Artificial Sequence: Synthetic polypeptide
DEEEISTTNPVATEGYGQCVCSNWGEDHNIENFGSDTQS

SEQ ID NO: 200874 - protein, 33 aa, Artificial Sequence
  Description of Artificial Sequence: Synthetic polypeptide
DENEIACTNPIATECWGATTWANAEDWAPGPYI

SEQ ID NO: 200875 - protein, 35 aa, Artificial Sequence
  Description of Artificial Sequence: Synthetic polypeptide
DETEIATTNPIATECWGATTWANNETWAEPKGPYR

SEQ ID NO: 200876 - protein, 34 aa, Artificial Sequence
  Description of Artificial Sequence: Synthetic polypeptide
DENEIACTNPIATECWGATTWANAENLAEPKGPI

SEQ ID NO: 200877 - protein, 35 aa, Artificial Sequence
  Description of Artificial Sequence: Synthetic polypeptide
DETEIRTTNPIATECWGATTWANAEDWAEPEGPYI

SEQ ID NO: 200878 - protein, 34 aa, Artificial Sequence
  Description of Artificial Sequence: Synthetic polypeptide
DETEIASTNPIATECWGNTVWAAATIAEPVGQYI

SEQ ID NO: 200879 - protein, 38 aa, Artificial Sequence
  Description of Artificial Sequence: Synthetic polypeptide
DEEEISCTNPVATEGYGQCVCSNWGEHNAENFNSETQS

SEQ ID NO: 200880 - protein, 39 aa, Artificial Sequence
  Description of Artificial Sequence: Synthetic polypeptide
DEEEISTTNPVATEGYGQCVCSNWGEDHNQENFGSDTQA

SEQ ID NO: 200881 - protein, 38 aa, Artificial Sequence
  Description of Artificial Sequence: Synthetic polypeptide
DEEEISTTNPVATEGYGQCVCSNWGEDHNQENFISDQS

SEQ ID NO: 200882 - protein, 35 aa, Artificial Sequence
  Description of Artificial Sequence: Synthetic polypeptide
DETEIRTTNPIATECWGATTWANAEDWAEPKGCYI

SEQ ID NO: 200883 - protein, 35 aa, Artificial Sequence
  Description of Artificial Sequence: Synthetic polypeptide
DETEIRTTNPIATECWGATTWANAEDWAVPKGPYI

SEQ ID NO: 200884 - protein, 35 aa, Artificial Sequence
  Description of Artificial Sequence: Synthetic polypeptide
DETEIRTTNPIATECWGATTWANAEDWAVPKGPDI

SEQ ID NO: 200885 - protein, 35 aa, Artificial Sequence
  Description of Artificial Sequence: Synthetic polypeptide
DETEIRTTNPIATECWGATTWANAEDWATPKGPYI

SEQ ID NO: 200886 - protein, 38 aa, Artificial Sequence
  Description of Artificial Sequence: Synthetic polypeptide
DEEEISTTNPVATEGYGQCVCSNWGEDHNQENFMSDQS

SEQ ID NO: 200887 - protein, 36 aa, Artificial Sequence
  Description of Artificial Sequence: Synthetic polypeptide
VEDEIATTNPVAYEQWGCVAGTGEPTEATAGGQNGN

SEQ ID NO: 200888 - protein, 35 aa, Artificial Sequence
  Description of Artificial Sequence: Synthetic polypeptide
DETEIRTTNPIATECWGATTWANAEDWASPKGPYI

SEQ ID NO: 200889 - protein, 39 aa, Artificial Sequence
  Description of Artificial Sequence: Synthetic polypeptide
QEGEIATTNPVATEQYGWISFSAPEDTLREPHEGLQDTR

SEQ ID NO: 200890 - protein, 37 aa, Artificial Sequence
  Description of Artificial Sequence: Synthetic polypeptide
DEDEIATTNPVATEQWGCICAGNGDHPGNNHPDDSNN

SEQ ID NO: 200891 - protein, 38 aa, Artificial Sequence
  Description of Artificial Sequence: Synthetic polypeptide
MEQEIRTTNPVATEQYGSIFNWCCPPDGSHEHGQFIKV

SEQ ID NO: 200892 - protein, 33 aa, Artificial Sequence
  Description of Artificial Sequence: Synthetic polypeptide
QEGEIACTNPCSYEQWGITCYCNDQQDQGDVLR

SEQ ID NO: 200893 - protein, 38 aa, Artificial Sequence
  Description of Artificial Sequence: Synthetic polypeptide
CEEEIACTNPVATEQYGSCAAAGGNHDPNAAAEEGNKT

SEQ ID NO: 200894 - protein, 35 aa, Artificial Sequence
  Description of Artificial Sequence: Synthetic polypeptide
DDSEVACTNPVSTEGYGNVCYNTIDQSRHGMQGDH

SEQ ID NO: 200895 - protein, 38 aa, Artificial Sequence
  Description of Artificial Sequence: Synthetic polypeptide
DEMEIGTTNPVAYEGYGCVTSTWGADHNAENFGSDPQA

SEQ ID NO: 200896 - protein, 38 aa, Artificial Sequence
  Description of Artificial Sequence: Synthetic polypeptide
DETAEIATTNPVAYERWGSAYITDNMNLQGQDEHGDGN

SEQ ID NO: 200897 - protein, 37 aa, Artificial Sequence
  Description of Artificial Sequence: Synthetic polypeptide
DENEICATNPVAYEQWGVVASGGPVGNTAGELREGSM

SEQ ID NO: 200898 - protein, 39 aa, Artificial Sequence
  Description of Artificial Sequence: Synthetic polypeptide
DEEEIGTTNPVAYEQYGQCVCSNWGEDHNAENFNSDTQS

SEQ ID NO: 200899 - protein, 34 aa, Artificial Sequence
  Description of Artificial Sequence: Synthetic polypeptide
DETEIASTNPIATECWGATTWAANETWAEPVGPR

SEQ ID NO: 200900 - protein, 35 aa, Artificial Sequence
  Description of Artificial Sequence: Synthetic polypeptide
DETEIRTTNPIATECWGATTWANAEDWAWPKGPYE

SEQ ID NO: 200901 - protein, 35 aa, Artificial Sequence
  Description of Artificial Sequence: Synthetic polypeptide
DETEICTTNPIATECWGATTWANAEDWAEQKGPYI

SEQ ID NO: 200902 - protein, 33 aa, Artificial Sequence
  Description of Artificial Sequence: Synthetic polypeptide
QEGEIACTNPCSYEQWGITCYCNDQQDHGHTVR

SEQ ID NO: 200903 - protein, 32 aa, Artificial Sequence
  Description of Artificial Sequence: Synthetic polypeptide
DDSEVASTNPVSTEGWGNTWANNTIASPVGPR

SEQ ID NO: 200904 - protein, 35 aa, Artificial Sequence
  Description of Artificial Sequence: Synthetic polypeptide
DETEIRTTNPIATECWGATTWANAEDWAEPIGPYI

SEQ ID NO: 200905 - protein, 36 aa, Artificial Sequence
  Description of Artificial Sequence: Synthetic polypeptide
QEGEIAPTNPCSYEQYGVTCSCCNMLSQSNGGTDRN

SEQ ID NO: 200906 - protein, 34 aa, Artificial Sequence
  Description of Artificial Sequence: Synthetic polypeptide
TTAEIATTNPCAYECWGSVTGGLNDDRQHQNNDQ

SEQ ID NO: 200907 - protein, 39 aa, Artificial Sequence
  Description of Artificial Sequence: Synthetic polypeptide
DEEEISTTNPVATEGYGQCVCSNWGEDHNQENFGSDTQS

SEQ ID NO: 200908 - protein, 34 aa, Artificial Sequence
  Description of Artificial Sequence: Synthetic polypeptide
DETEIAPTNPIATEQWGATVANAEDWAEPKGTYI

SEQ ID NO: 200909 - protein, 35 aa, Artificial Sequence
  Description of Artificial Sequence: Synthetic polypeptide
TTAEIATTNPTAYEAWGSVSWGEDTEQNMNKKGDM

SEQ ID NO: 200910 - protein, 32 aa, Artificial Sequence
  Description of Artificial Sequence: Synthetic polypeptide
QEGEIACTNPCSYEQWGITCYCNDQQDHGKQD

SEQ ID NO: 200911 - protein, 38 aa, Artificial Sequence
  Description of Artificial Sequence: Synthetic polypeptide
CEAEISTTNPVATEQYGCVCSDWGEDHNAENFNSDTQA

SEQ ID NO: 200912 - protein, 38 aa, Artificial Sequence
  Description of Artificial Sequence: Synthetic polypeptide
NDSESEICTTNPVAYEQWGEVYYFNDGHQNKGPGENEY

SEQ ID NO: 200913 - protein, 36 aa, Artificial Sequence
  Description of Artificial Sequence: Synthetic polypeptide
QEEEIATTNPVAYEWYGEHAPWCLHEFSQSHNEGEL

SEQ ID NO: 200914 - protein, 35 aa, Artificial Sequence
  Description of Artificial Sequence: Synthetic polypeptide
DETEIRTTNPIATECWGATTWANAEDWCEPKGPYI

SEQ ID NO: 200915 - protein, 36 aa, Artificial Sequence
  Description of Artificial Sequence: Synthetic polypeptide
DEMEIRTTNPIATEGWGCQTCANAEDDAENSGSENI

SEQ ID NO: 200916 - protein, 36 aa, Artificial Sequence
  Description of Artificial Sequence: Synthetic polypeptide
QEEEIATTNPVAYEWYGEHAPWCESEFSQSHAEGEF

SEQ ID NO: 200917 - protein, 39 aa, Artificial Sequence
  Description of Artificial Sequence: Synthetic polypeptide
DEEEISTTNPVATEEYGCQVCSNWGEDHNAENFNSETQS

SEQ ID NO: 200918 - protein, 39 aa, Artificial Sequence
  Description of Artificial Sequence: Synthetic polypeptide
DEREISTTNPVATEQYGQCVCSNSGEDHNAENFISDNQS

SEQ ID NO: 200919 - protein, 35 aa, Artificial Sequence
  Description of Artificial Sequence: Synthetic polypeptide
DETEIRTTNPIATECWGATTWANAEDWAEPKGAYI

SEQ ID NO: 200920 - protein, 35 aa, Artificial Sequence
  Description of Artificial Sequence: Synthetic polypeptide
VEDEIATTNPVAYEPWGSTPAATNGETGTGGSTEN

SEQ ID NO: 200921 - protein, 35 aa, Artificial Sequence
  Description of Artificial Sequence: Synthetic polypeptide
DETEIRTTNPIATECWGATTWANAEDWAEPKGAYN

SEQ ID NO: 200922 - protein, 37 aa, Artificial Sequence
  Description of Artificial Sequence: Synthetic polypeptide
DEDEIATTNPVATEQWGCNCATAGDHPGDNHPDDSNN

SEQ ID NO: 200923 - protein, 36 aa, Artificial Sequence
  Description of Artificial Sequence: Synthetic polypeptide
DEDEIATTNPVAYEAWGVVWPGPNNENDNGQQNGDD

SEQ ID NO: 200924 - protein, 35 aa, Artificial Sequence
  Description of Artificial Sequence: Synthetic polypeptide
DETEIRTTNPIATECWGATTWANAEDWAEPKGPGI

SEQ ID NO: 200925 - protein, 38 aa, Artificial Sequence
  Description of Artificial Sequence: Synthetic polypeptide
DENEISTTNPVATEGYGQCVCSNSGEHNIEYFNSDNQS

SEQ ID NO: 200926 - protein, 38 aa, Artificial Sequence
  Description of Artificial Sequence: Synthetic polypeptide
DEEEISTTNPVATEGYGCSCSNWGEPHNQENFISDTQS

SEQ ID NO: 200927 - protein, 35 aa, Artificial Sequence
  Description of Artificial Sequence: Synthetic polypeptide
DETEIRTTNPIATECWGATTWANAEDWAEPKGPPI

SEQ ID NO: 200928 - protein, 35 aa, Artificial Sequence
  Description of Artificial Sequence: Synthetic polypeptide
DETEIRTTNPIATECWGATTWANAEDWAEPKGPPV

SEQ ID NO: 200929 - protein, 37 aa, Artificial Sequence
  Description of Artificial Sequence: Synthetic polypeptide
DEMEIRTTNPIATEGWGCQTCGNAEDDNAENSGSENQ

SEQ ID NO: 200930 - protein, 38 aa, Artificial Sequence
  Description of Artificial Sequence: Synthetic polypeptide
DEDEIACTNPVAYEQWGHSVSAMWPAGTNQGNPMEGVN

SEQ ID NO: 200931 - protein, 35 aa, Artificial Sequence
  Description of Artificial Sequence: Synthetic polypeptide
DETEIRTTNPIATECWGATTWANAEDWAEPKGPYY

SEQ ID NO: 200932 - protein, 35 aa, Artificial Sequence
  Description of Artificial Sequence: Synthetic polypeptide
DDSEVASTNPVSTEGYGCVCQNSEIQEYFGSQNQA

SEQ ID NO: 200933 - protein, 34 aa, Artificial Sequence
  Description of Artificial Sequence: Synthetic polypeptide
QENEIATTNPVAYAPWGNTVAGEGHLQNHMNLKK

SEQ ID NO: 200934 - protein, 33 aa, Artificial Sequence
  Description of Artificial Sequence: Synthetic polypeptide
QEGEIACTNPCSYEQWGITCYCWNDQQDKGDTR

SEQ ID NO: 200935 - protein, 35 aa, Artificial Sequence
  Description of Artificial Sequence: Synthetic polypeptide
DETEIRTTNPIATECWGATTWANAEDWAEPKGPQI

SEQ ID NO: 200936 - protein, 34 aa, Artificial Sequence
  Description of Artificial Sequence: Synthetic polypeptide
DETEIRCTNPIATECWGATTWANADWAEPKGPYI

SEQ ID NO: 200937 - protein, 37 aa, Artificial Sequence
  Description of Artificial Sequence: Synthetic polypeptide
VEDEIATTNPVAYEQWGSVVANTGAQPNHSMNDETNK

SEQ ID NO: 200938 - protein, 35 aa, Artificial Sequence
  Description of Artificial Sequence: Synthetic polypeptide
DETEIRTTNPIATECWGATTWANAEDWAEPKGPYW

SEQ ID NO: 200939 - protein, 35 aa, Artificial Sequence
  Description of Artificial Sequence: Synthetic polypeptide
DETEIRTTNPIATECWGATTWANAEDWAEPKGPYV

SEQ ID NO: 200940 - protein, 35 aa, Artificial Sequence
  Description of Artificial Sequence: Synthetic polypeptide
DETEIRTTNPIATECWGATTWANAEDWAEPKGPYT

SEQ ID NO: 200941 - protein, 35 aa, Artificial Sequence
  Description of Artificial Sequence: Synthetic polypeptide
DETEIRTTNPIATECWGATTWANAEDWAEPKGPYS

SEQ ID NO: 200942 - protein, 39 aa, Artificial Sequence
  Description of Artificial Sequence: Synthetic polypeptide
DENEISTTNPVATEGYGQCVCSNSGEDHNQENFGSDNQM

SEQ ID NO: 200943 - protein, 37 aa, Artificial Sequence
  Description of Artificial Sequence: Synthetic polypeptide
DENEISTTNPVSTEGYGCICSTWEEDNQEYFGSDTQS

SEQ ID NO: 200944 - protein, 35 aa, Artificial Sequence
  Description of Artificial Sequence: Synthetic polypeptide
DETEIRCTNPIATECWGATTTANAEDWAEPKGPYI

SEQ ID NO: 200945 - protein, 38 aa, Artificial Sequence
  Description of Artificial Sequence: Synthetic polypeptide
CEAEISTTNPVATEQYGCVCSMSGEDHNQENFNSDTQS

SEQ ID NO: 200946 - protein, 39 aa, Artificial Sequence
  Description of Artificial Sequence: Synthetic polypeptide
DEAEIRTTNPVATEQYGTFIYEGTETPDSSMVATGNQDF

SEQ ID NO: 200947 - protein, 37 aa, Artificial Sequence
  Description of Artificial Sequence: Synthetic polypeptide
AEEEIATTNPVATEGYGCSCQNWGEDNIEHFISENQA

SEQ ID NO: 200948 - protein, 35 aa, Artificial Sequence
  Description of Artificial Sequence: Synthetic polypeptide
DETEIRTTNPIATECWGATTWANAEDWAEPKGQYI

SEQ ID NO: 200949 - protein, 36 aa, Artificial Sequence
  Description of Artificial Sequence: Synthetic polypeptide
DETEIRTTNPIATECWGATTWANAEDWAEPKGPNIT

SEQ ID NO: 200950 - protein, 35 aa, Artificial Sequence
  Description of Artificial Sequence: Synthetic polypeptide
DETEIRTTNPIATECWGATTWANAEDWAEPKGWYI

SEQ ID NO: 200951 - protein, 35 aa, Artificial Sequence
  Description of Artificial Sequence: Synthetic polypeptide
DETEIRTTNPIATECWGATTWANAEDWAEPKGVYI

SEQ ID NO: 200952 - protein, 35 aa, Artificial Sequence
  Description of Artificial Sequence: Synthetic polypeptide
DETEIRTTNPIATECWGATTWANAEDWAEPKGTYI

SEQ ID NO: 200953 - protein, 35 aa, Artificial Sequence
  Description of Artificial Sequence: Synthetic polypeptide
DETEIRTTNPIATECWGATTWANAEDWAEPKGPMI

SEQ ID NO: 200954 - protein, 36 aa, Artificial Sequence
  Description of Artificial Sequence: Synthetic polypeptide
QAEEIATTNPVATEQYGCVAPGEGGHGQESAEEDGH

SEQ ID NO: 200955 - protein, 36 aa, Artificial Sequence
  Description of Artificial Sequence: Synthetic polypeptide
VEDEIACTNPVAYEQWGCSAATGPLPADAGGGNDHL

SEQ ID NO: 200956 - protein, 38 aa, Artificial Sequence
  Description of Artificial Sequence: Synthetic polypeptide
DEEEISCTNPVATEQYGCVCSNWGEDDNDENFISQTQS

SEQ ID NO: 200957 - protein, 35 aa, Artificial Sequence
  Description of Artificial Sequence: Synthetic polypeptide
DETEIRTTNPIATECWGATTWANAEDWAEPKGSYI

SEQ ID NO: 200958 - protein, 37 aa, Artificial Sequence
  Description of Artificial Sequence: Synthetic polypeptide
DESTICTTNCVATEFYGQVSVVDIMNVGLEGGGDDED

SEQ ID NO: 200959 - protein, 35 aa, Artificial Sequence
  Description of Artificial Sequence: Synthetic polypeptide
DETEIHTTNPIATECWGATTWTNAEDWAEPKGPYI

SEQ ID NO: 200960 - protein, 37 aa, Artificial Sequence
  Description of Artificial Sequence: Synthetic polypeptide
DEDEIACTNPVAYEQWGSICSVANPALQEHMIDITAA

SEQ ID NO: 200961 - protein, 38 aa, Artificial Sequence
  Description of Artificial Sequence: Synthetic polypeptide
WEEEIATTNPVATAQWGCSFVANANGLPPEAPGEMMDA

SEQ ID NO: 200962 - protein, 37 aa, Artificial Sequence
  Description of Artificial Sequence: Synthetic polypeptide
DEDEIACTNPVAYEQWGSICSPANPATQEHGIDGTAM

SEQ ID NO: 200963 - protein, 37 aa, Artificial Sequence
  Description of Artificial Sequence: Synthetic polypeptide
CEEEIACTNPVATEQYGSCAAGGNHDPNAAPEEMNNE

SEQ ID NO: 200964 - protein, 37 aa, Artificial Sequence
  Description of Artificial Sequence: Synthetic polypeptide
DEDEIRGTNCVATEAWGICVSAINGEGGDGEGEENGT

SEQ ID NO: 200965 - protein, 35 aa, Artificial Sequence
  Description of Artificial Sequence: Synthetic polypeptide
DETEIRTTNPIATECWGATTWANAEDWAEPKGRYI

SEQ ID NO: 200966 - protein, 37 aa, Artificial Sequence
  Description of Artificial Sequence: Synthetic polypeptide
ADECISTTNPVATEQYGCVCSWMEDHNQENFGSDTQS

SEQ ID NO: 200967 - protein, 37 aa, Artificial Sequence
  Description of Artificial Sequence: Synthetic polypeptide
VEDEIATTNPVAYEQWGSVVANMGAQPNHSMNDNTNH

SEQ ID NO: 200968 - protein, 37 aa, Artificial Sequence
  Description of Artificial Sequence: Synthetic polypeptide
NEMEICTTNPVATEQYGCACICHATDGPTVEFEGNDI

SEQ ID NO: 200969 - protein, 38 aa, Artificial Sequence
  Description of Artificial Sequence: Synthetic polypeptide
DEDEIATTNPVAYEQWGSASGGEPGNGGNMRNKMEQMN

SEQ ID NO: 200970 - protein, 39 aa, Artificial Sequence
  Description of Artificial Sequence: Synthetic polypeptide
DEEEISTTNPVATEGYGQCVCSNWGEPHNAENFNSDNQS

SEQ ID NO: 200971 - protein, 38 aa, Artificial Sequence
  Description of Artificial Sequence: Synthetic polypeptide
DEAEIRCTNPVATEGYGQCVCSNWGEDNDEYFNSDTQA

SEQ ID NO: 200972 - protein, 35 aa, Artificial Sequence
  Description of Artificial Sequence: Synthetic polypeptide
DETEIRTTNPIATECWGATTWANAEDWAEPKGPSI

SEQ ID NO: 200973 - protein, 36 aa, Artificial Sequence
  Description of Artificial Sequence: Synthetic polypeptide
VEDEIATTNPVAYEQWGTACAATAGELPDSPGENGN

SEQ ID NO: 200974 - protein, 38 aa, Artificial Sequence
  Description of Artificial Sequence: Synthetic polypeptide
DEDEIATTNPVAYEQWGSIICPAVADAEQDHQGDNTEI

SEQ ID NO: 200975 - protein, 35 aa, Artificial Sequence
  Description of Artificial Sequence: Synthetic polypeptide
DETEIRTTNPIATECWGATTWANAEDWAEPKGPYG

SEQ ID NO: 200976 - protein, 38 aa, Artificial Sequence
  Description of Artificial Sequence: Synthetic polypeptide
DEEEISTTNPVATEGYGQCVCSNWGEHNQENFISDTQG

SEQ ID NO: 200977 - protein, 38 aa, Artificial Sequence
  Description of Artificial Sequence: Synthetic polypeptide
AEECISTTNPVATEQYGQCVCSNWGEDNAENFNSDFQA

SEQ ID NO: 200978 - protein, 39 aa, Artificial Sequence
  Description of Artificial Sequence: Synthetic polypeptide
DDEEIRTTNPVATEGYGQCVCSNWGEDHNAENFNSDNQS

SEQ ID NO: 200979 - protein, 37 aa, Artificial Sequence
  Description of Artificial Sequence: Synthetic polypeptide
DETCIRTTNPCATEQFGCVCSNWGEHNQESFGSDTQA

SEQ ID NO: 200980 - protein, 34 aa, Artificial Sequence
  Description of Artificial Sequence: Synthetic polypeptide
DETEIATTNPIATECWGATAWANEEDWAEPKGPI

SEQ ID NO: 200981 - protein, 39 aa, Artificial Sequence
  Description of Artificial Sequence: Synthetic polypeptide
MEPEIRATNPVATEQYGSVANDDGDQEGGQNDDTTDEFT

SEQ ID NO: 200982 - protein, 38 aa, Artificial Sequence
  Description of Artificial Sequence: Synthetic polypeptide
CEAEISTTNPVATEQYGCVCSNWGEGHNAENFNSDTQS

SEQ ID NO: 200983 - protein, 38 aa, Artificial Sequence
  Description of Artificial Sequence: Synthetic polypeptide
CEEEIACTNPVATEQYGSACSAANPGTPAEAPIGDAHQ

SEQ ID NO: 200984 - protein, 35 aa, Artificial Sequence
  Description of Artificial Sequence: Synthetic polypeptide
DETEIRTTNPIATECWGATTWANAEDWAEPKGPWI

SEQ ID NO: 200985 - protein, 35 aa, Artificial Sequence
  Description of Artificial Sequence: Synthetic polypeptide
DETEIRTTNPIATECWGATTWANAEDWAEPKGPYF

SEQ ID NO: 200986 - protein, 35 aa, Artificial Sequence
  Description of Artificial Sequence: Synthetic polypeptide
DETEIRTTNPIATECWGATTWANAEDWAEPKGPYE

SEQ ID NO: 200987 - protein, 38 aa, Artificial Sequence
  Description of Artificial Sequence: Synthetic polypeptide
DEEEISTTNPVATEGYGQCVCSNWGEHNQENFFSETQS

SEQ ID NO: 200988 - protein, 37 aa, Artificial Sequence
  Description of Artificial Sequence: Synthetic polypeptide
MEPEIRTTNPVATEFYGCVGANQTDGGEFEEDGGEED

SEQ ID NO: 200989 - protein, 35 aa, Artificial Sequence
  Description of Artificial Sequence: Synthetic polypeptide
DETEIRTTNPIATECWGATTWANAEDWAEPKGPYD

SEQ ID NO: 200990 - protein, 35 aa, Artificial Sequence
  Description of Artificial Sequence: Synthetic polypeptide
DETEIRTTNPIATECWGATTWANAEDWAEPKGPYC

SEQ ID NO: 200991 - protein, 35 aa, Artificial Sequence
  Description of Artificial Sequence: Synthetic polypeptide
DETEIRATNPIATECWGATVWANAEDWAEPKGPYI

SEQ ID NO: 200992 - protein, 38 aa, Artificial Sequence
  Description of Artificial Sequence: Synthetic polypeptide
QAEEIATTNPVATEQYGSVCAPVGDNHHNIDAMGEGAN

SEQ ID NO: 200993 - protein, 35 aa, Artificial Sequence
  Description of Artificial Sequence: Synthetic polypeptide
DAEEIATTNPVGYAQWGGCPSAGNNLATMNPGDPH

SEQ ID NO: 200994 - protein, 35 aa, Artificial Sequence
  Description of Artificial Sequence: Synthetic polypeptide
DETEIRTTNPIATECWGATTWANAEDWAEPKGPYH

SEQ ID NO: 200995 - protein, 38 aa, Artificial Sequence
  Description of Artificial Sequence: Synthetic polypeptide
DEDEIATTNPVAYEQWGSICSAANPPAPENHGGDNEAM

SEQ ID NO: 200996 - protein, 35 aa, Artificial Sequence
  Description of Artificial Sequence: Synthetic polypeptide
DETEIRTTNPIATECWGATTWANAEDWAEPKGPYQ

SEQ ID NO: 200997 - protein, 35 aa, Artificial Sequence
  Description of Artificial Sequence: Synthetic polypeptide
DETEIRTTNPIATECWGATTWANAEDWAEPKGPTI

SEQ ID NO: 200998 - protein, 35 aa, Artificial Sequence
  Description of Artificial Sequence: Synthetic polypeptide
DETEIRTTNPIATECWGATTWANAEDWAEPKGPYP

SEQ ID NO: 200999 - protein, 35 aa, Artificial Sequence
  Description of Artificial Sequence: Synthetic polypeptide
DETEIRTTNPIATECWGATTWANAEDWAEPKGPYN

SEQ ID NO: 201000 - protein, 35 aa, Artificial Sequence
  Description of Artificial Sequence: Synthetic polypeptide
DETEIRTTNPIATECWGATTWANAEDWAEPKGPYM

SEQ ID NO: 201001 - protein, 35 aa, Artificial Sequence
  Description of Artificial Sequence: Synthetic polypeptide
DETEIRTTNPIATECWGATTWANAEDWAEPKGPYL

SEQ ID NO: 201002 - protein, 37 aa, Artificial Sequence
  Description of Artificial Sequence: Synthetic polypeptide
QAEEIATTNPVATEQYGCVAPGEGGHGQESGEEAGYN

SEQ ID NO: 201003 - protein, 34 aa, Artificial Sequence
  Description of Artificial Sequence: Synthetic polypeptide
DDSEVASTNPVSTEGYGCVCQTWEIAERFGSQQA

SEQ ID NO: 201004 - protein, 39 aa, Artificial Sequence
  Description of Artificial Sequence: Synthetic polypeptide
MEGEIRTTNPVATEWYGSTCSSPAPEEGPNMKFEGNIDC

SEQ ID NO: 201005 - protein, 35 aa, Artificial Sequence
  Description of Artificial Sequence: Synthetic polypeptide
DETEIRTTNPIATECWGATTWANAEDWAEPKGPYK

SEQ ID NO: 201006 - protein, 39 aa, Artificial Sequence
  Description of Artificial Sequence: Synthetic polypeptide
DEEEISTTNPVATEAYGQCVCSNWGEDHNAEGFNSDNQS

SEQ ID NO: 201007 - protein, 39 aa, Artificial Sequence
  Description of Artificial Sequence: Synthetic polypeptide
VENEIRSTNPVATEFYGVVNTTDGGNNLLHEEDEGNEGP

SEQ ID NO: 201008 - protein, 36 aa, Artificial Sequence
  Description of Artificial Sequence: Synthetic polypeptide
DETEIRTTNPIATECWGATTWANAEDWAEPKGPYIR

SEQ ID NO: 201009 - protein, 38 aa, Artificial Sequence
  Description of Artificial Sequence: Synthetic polypeptide
MENEIRTVNPVATEFYGTVTTGGDDGEGQLEGVGGNGT

SEQ ID NO: 201010 - protein, 35 aa, Artificial Sequence
  Description of Artificial Sequence: Synthetic polypeptide
DETEIRTTNPIATECWGATTWANAEDWAEPKGPVI

SEQ ID NO: 201011 - protein, 38 aa, Artificial Sequence
  Description of Artificial Sequence: Synthetic polypeptide
DESSVIACTNPVATEQWGCVAGTANGLPDGAGSEMNEE

SEQ ID NO: 201012 - protein, 39 aa, Artificial Sequence
  Description of Artificial Sequence: Synthetic polypeptide
DEMEIRTTNPVATEQYGQCSCSNWPEDDNIENFDSDTQS

SEQ ID NO: 201013 - protein, 37 aa, Artificial Sequence
  Description of Artificial Sequence: Synthetic polypeptide
DEDEIATTNPVATEQWGCICAGTGDHPGDNHPDDSAN

SEQ ID NO: 201014 - protein, 37 aa, Artificial Sequence
  Description of Artificial Sequence: Synthetic polypeptide
CEAEISTTNPVATEQYGCVCSNWGEDHNANFNSDTQS

SEQ ID NO: 201015 - protein, 38 aa, Artificial Sequence
  Description of Artificial Sequence: Synthetic polypeptide
DEEEISTTNPVATEGYGQCVCSNWGEHNQENFPSDTQS

SEQ ID NO: 201016 - protein, 35 aa, Artificial Sequence
  Description of Artificial Sequence: Synthetic polypeptide
TTDEIATTNPVAYEAWGSVYYVIDDEQGQGGNGEV

SEQ ID NO: 201017 - protein, 39 aa, Artificial Sequence
  Description of Artificial Sequence: Synthetic polypeptide
DEEEISTTNPVATEAYGQCVCSNWGEDHNAENFNSDPQS

SEQ ID NO: 201018 - protein, 37 aa, Artificial Sequence
  Description of Artificial Sequence: Synthetic polypeptide
CEDEIACTNPVATEQYGSACSADNPYPAEAPIGDAHQ

SEQ ID NO: 201019 - protein, 35 aa, Artificial Sequence
  Description of Artificial Sequence: Synthetic polypeptide
DETEIRTTNPIATECWGATTWANAEDWAEPVGRYI

SEQ ID NO: 201020 - protein, 34 aa, Artificial Sequence
  Description of Artificial Sequence: Synthetic polypeptide
DETEIATTNPIATECWGATTWANAEDWAEPKGQI

SEQ ID NO: 201021 - protein, 33 aa, Artificial Sequence
  Description of Artificial Sequence: Synthetic polypeptide
AESEIASTNPVGTEGWGVCAPTDRDQHNGDDSI

SEQ ID NO: 201022 - protein, 35 aa, Artificial Sequence
  Description of Artificial Sequence: Synthetic polypeptide
DETEIRTTNPIATECWGATTWANAEDWAEPVGPYI

SEQ ID NO: 201023 - protein, 34 aa, Artificial Sequence
  Description of Artificial Sequence: Synthetic polypeptide
DETEIATTNPIATECWGATTWANAEDWAEPKGPI

SEQ ID NO: 201024 - protein, 38 aa, Artificial Sequence
  Description of Artificial Sequence: Synthetic polypeptide
MEGEIRTTNPVATEWYGSCCCPAPEEGPNMWFEGNSNC

SEQ ID NO: 201025 - protein, 35 aa, Artificial Sequence
  Description of Artificial Sequence: Synthetic polypeptide
DETEIRTTNPIATECWGATTWANAEDWAEPKGPII

SEQ ID NO: 201026 - protein, 34 aa, Artificial Sequence
  Description of Artificial Sequence: Synthetic polypeptide
DEEEIASTNPIATECWGATWANAEDWAEPKGPYQ

SEQ ID NO: 201027 - protein, 36 aa, Artificial Sequence
  Description of Artificial Sequence: Synthetic polypeptide
VEDEIATTNPVAYEPWGTFACAATAGELPDSGSNPR

SEQ ID NO: 201028 - protein, 35 aa, Artificial Sequence
  Description of Artificial Sequence: Synthetic polypeptide
DETEIRTTNPIATECWGATTWANAEDWAEPKGPKI

SEQ ID NO: 201029 - protein, 33 aa, Artificial Sequence
  Description of Artificial Sequence: Synthetic polypeptide
AESEIAATNPVGTEGWGVCAPTERDQHQGQDDK

SEQ ID NO: 201030 - protein, 35 aa, Artificial Sequence
  Description of Artificial Sequence: Synthetic polypeptide
DETEIRTTNPIATECWGATTWANAEDWAEPTGPYI

SEQ ID NO: 201031 - protein, 35 aa, Artificial Sequence
  Description of Artificial Sequence: Synthetic polypeptide
DETEIRTTNPIATECWGATTWANAEDWAEPSGRYI

SEQ ID NO: 201032 - protein, 35 aa, Artificial Sequence
  Description of Artificial Sequence: Synthetic polypeptide
DETEIRTTNPIATECWGATTWANAEDWAEPSGPYI

SEQ ID NO: 201033 - protein, 38 aa, Artificial Sequence
  Description of Artificial Sequence: Synthetic polypeptide
DEEEIACTNPVATEQWGHSVAACPGNSHPSAEDSGETE

SEQ ID NO: 201034 - protein, 33 aa, Artificial Sequence
  Description of Artificial Sequence: Synthetic polypeptide
AESEIAATNPVGTEGWGVCAPTDRDQHQGQGDP

SEQ ID NO: 201035 - protein, 36 aa, Artificial Sequence
  Description of Artificial Sequence: Synthetic polypeptide
VEDEIACTNPVAYEQWGCIAGTNGQNPTDSGSNDSL

SEQ ID NO: 201036 - protein, 35 aa, Artificial Sequence
  Description of Artificial Sequence: Synthetic polypeptide
DETEIRTTNPIATECWGATTWANAEDWAEPQIPYI

SEQ ID NO: 201037 - protein, 35 aa, Artificial Sequence
  Description of Artificial Sequence: Synthetic polypeptide
DETEIRTTNPIATECWGATTWANAEDWAEPQGPYI

SEQ ID NO: 201038 - protein, 34 aa, Artificial Sequence
  Description of Artificial Sequence: Synthetic polypeptide
DETEIATTNPIATECWGATTWANAEDWAEPVGQI

SEQ ID NO: 201039 - protein, 38 aa, Artificial Sequence
  Description of Artificial Sequence: Synthetic polypeptide
MEGEIRTTNPVATEWYGSCCQPAPEEGPNMSFEGNSDC

SEQ ID NO: 201040 - protein, 35 aa, Artificial Sequence
  Description of Artificial Sequence: Synthetic polypeptide
DETEIRTTNPIATECWGATTWANAEDWAEPYGPCI

SEQ ID NO: 201041 - protein, 39 aa, Artificial Sequence
  Description of Artificial Sequence: Synthetic polypeptide
DEEEISTTNPVATEGYGQCVCSNWGEEHNIENFNSDTQS

SEQ ID NO: 201042 - protein, 34 aa, Artificial Sequence
  Description of Artificial Sequence: Synthetic polypeptide
DETEIATTNPCATECWGATTWANADWAEPKGPYI

SEQ ID NO: 201043 - protein, 37 aa, Artificial Sequence
  Description of Artificial Sequence: Synthetic polypeptide
CEDEIACTNPVATEQYGSACAANPAEEAGPHQDNDFP

SEQ ID NO: 201044 - protein, 37 aa, Artificial Sequence
  Description of Artificial Sequence: Synthetic polypeptide
VEDEIATTNPVAYEPYGSVVAANMGGLPASDNNENNN

SEQ ID NO: 201045 - protein, 35 aa, Artificial Sequence
  Description of Artificial Sequence: Synthetic polypeptide
TENEIATTNPTAYEQWGATYYSMEIEANQREMDYR

SEQ ID NO: 201046 - protein, 37 aa, Artificial Sequence
  Description of Artificial Sequence: Synthetic polypeptide
CEDEIACTNPVATEQWGCVVAATGELADIGNSDESAM

SEQ ID NO: 201047 - protein, 35 aa, Artificial Sequence
  Description of Artificial Sequence: Synthetic polypeptide
DETEIRTTNPIATECWGATTWANAEDWAERKTPYI

SEQ ID NO: 201048 - protein, 36 aa, Artificial Sequence
  Description of Artificial Sequence: Synthetic polypeptide
CEEVIACTNPVATEQYGSVCAAGPPGFATPGDIEAM

SEQ ID NO: 201049 - protein, 38 aa, Artificial Sequence
  Description of Artificial Sequence: Synthetic polypeptide
AEEAISTTNPVATEQYGQCVCSNWGEDNAENFNSDNQS

SEQ ID NO: 201050 - protein, 37 aa, Artificial Sequence
  Description of Artificial Sequence: Synthetic polypeptide
DETEICTTNPVAYEQWGEVCVQWDNGERERQNQGESG

SEQ ID NO: 201051 - protein, 35 aa, Artificial Sequence
  Description of Artificial Sequence: Synthetic polypeptide
DEMEIRTTNPCATECWGATTWANAEDWEETQIPQI

SEQ ID NO: 201052 - protein, 37 aa, Artificial Sequence
  Description of Artificial Sequence: Synthetic polypeptide
VEDEIATTNPVAYEPYGSVVAANMGGLPASDMNNMNN

SEQ ID NO: 201053 - protein, 37 aa, Artificial Sequence
  Description of Artificial Sequence: Synthetic polypeptide
DENEICTTNPVATEQYGQAFTDWCYDPQTQFQSEQIM

SEQ ID NO: 201054 - protein, 37 aa, Artificial Sequence
  Description of Artificial Sequence: Synthetic polypeptide
DEDEIACTNPVAYEQWGSVCSANPALPGEHMIDQTAM

SEQ ID NO: 201055 - protein, 35 aa, Artificial Sequence
  Description of Artificial Sequence: Synthetic polypeptide
DETEIRTTNPIATECWGATTWANAEDWAEPKGPHI

SEQ ID NO: 201056 - protein, 36 aa, Artificial Sequence
  Description of Artificial Sequence: Synthetic polypeptide
DEDEIRGTNCVATDAWGGVSAINGEGGDGEGEENQT

SEQ ID NO: 201057 - protein, 36 aa, Artificial Sequence
  Description of Artificial Sequence: Synthetic polypeptide
DETEIRTTNPIATECWGATTWANAEDWAERKGCPYI

SEQ ID NO: 201058 - protein, 39 aa, Artificial Sequence
  Description of Artificial Sequence: Synthetic polypeptide
DEEEISTTNPVATEAYGQCVCSNWGEDHNIENFNSDTQG

SEQ ID NO: 201059 - protein, 33 aa, Artificial Sequence
  Description of Artificial Sequence: Synthetic polypeptide
AESEIASTNPVGTEGWGVCAPTDRDQHNGDGIH

SEQ ID NO: 201060 - protein, 34 aa, Artificial Sequence
  Description of Artificial Sequence: Synthetic polypeptide
DETEIRTTNPIATECWGATTWANAEDWAEPYPYI

SEQ ID NO: 201061 - protein, 35 aa, Artificial Sequence
  Description of Artificial Sequence: Synthetic polypeptide
DETEIRTTNPIATECWGATTWANAEDWAEPYGPYI

SEQ ID NO: 201062 - protein, 39 aa, Artificial Sequence
  Description of Artificial Sequence: Synthetic polypeptide
DDEEIRTTNPVATEGYGQCVCSNWGEDHNAENFNSDTQA

SEQ ID NO: 201063 - protein, 38 aa, Artificial Sequence
  Description of Artificial Sequence: Synthetic polypeptide
CEMCIRTTNPVATEQYGQCVCSNWGEHNQENFNSDNQS

SEQ ID NO: 201064 - protein, 36 aa, Artificial Sequence
  Description of Artificial Sequence: Synthetic polypeptide
NEAEIASTNPVAYEQWGSVVCGNAQLDHVDFSGDHQ

SEQ ID NO: 201065 - protein, 38 aa, Artificial Sequence
  Description of Artificial Sequence: Synthetic polypeptide
CEAEISTTNPVATEQYGCVCSMSGEDHNAEHFNSDNQN

SEQ ID NO: 201066 - protein, 37 aa, Artificial Sequence
  Description of Artificial Sequence: Synthetic polypeptide
DESEIRTTNPVAYEGWGCVCSWGEDDNAEYFGSDTQA

SEQ ID NO: 201067 - protein, 37 aa, Artificial Sequence
  Description of Artificial Sequence: Synthetic polypeptide
YEDEIRCTNPVATEGYGMVDNNDEFDEEDEDGGNQGN

SEQ ID NO: 201068 - protein, 39 aa, Artificial Sequence
  Description of Artificial Sequence: Synthetic polypeptide
MEGEIRTTNPVATEWYGSSCSSPAPEEGPNTVFEGNNDC

SEQ ID NO: 201069 - protein, 35 aa, Artificial Sequence
  Description of Artificial Sequence: Synthetic polypeptide
DETEIRTTNPIATECWGATTWANAEDWAEPKRPYI

SEQ ID NO: 201070 - protein, 38 aa, Artificial Sequence
  Description of Artificial Sequence: Synthetic polypeptide
DEEEISTTNPVATEGYGQCVCSWGEDDNAENFISDTQS

SEQ ID NO: 201071 - protein, 38 aa, Artificial Sequence
  Description of Artificial Sequence: Synthetic polypeptide
DETEIACTNPVATEQYGSACSLAGDPQGFDHQGDGQLP

SEQ ID NO: 201072 - protein, 38 aa, Artificial Sequence
  Description of Artificial Sequence: Synthetic polypeptide
DESEIRTTNPVAYEGWGCVCSTWGEDENQEYFGSDTQS

SEQ ID NO: 201073 - protein, 36 aa, Artificial Sequence
  Description of Artificial Sequence: Synthetic polypeptide
DESSISTTNPVAYECWGSVYHGENQDLREGTQGQQG

SEQ ID NO: 201074 - protein, 39 aa, Artificial Sequence
  Description of Artificial Sequence: Synthetic polypeptide
AEECISTTNPVATEQYGQCVCSNWMEDHNAENFGSENQS

SEQ ID NO: 201075 - protein, 35 aa, Artificial Sequence
  Description of Artificial Sequence: Synthetic polypeptide
DETEIRTTNPIATECWGATTWANAEDWAEPKNPYI

SEQ ID NO: 201076 - protein, 37 aa, Artificial Sequence
  Description of Artificial Sequence: Synthetic polypeptide
DESEIRTTNPVAYEGWGCVCSNWGEENAEYFNSDTQS

SEQ ID NO: 201077 - protein, 38 aa, Artificial Sequence
  Description of Artificial Sequence: Synthetic polypeptide
DEDEIATTNPVAYEQWGSISGGEPGNGGNMRRKMESDN

SEQ ID NO: 201078 - protein, 34 aa, Artificial Sequence
  Description of Artificial Sequence: Synthetic polypeptide
DETEIATTNPIATECWGATTWAAEDLAEPKGPYI

SEQ ID NO: 201079 - protein, 37 aa, Artificial Sequence
  Description of Artificial Sequence: Synthetic polypeptide
TEEEISTTNPVAYENYGTVSACIGYEGQQNKFGTQIE

SEQ ID NO: 201080 - protein, 34 aa, Artificial Sequence
  Description of Artificial Sequence: Synthetic polypeptide
DDSEVASTNPVSTEGYGCVCQTWEPQEYFGSQQA

SEQ ID NO: 201081 - protein, 38 aa, Artificial Sequence
  Description of Artificial Sequence: Synthetic polypeptide
AEECISTTNPVATEQYGCVCSNWGEDDNDENFNSDTQA

SEQ ID NO: 201082 - protein, 38 aa, Artificial Sequence
  Description of Artificial Sequence: Synthetic polypeptide
WEEEIATTNPVATAQWGCSFNANANGLPPEAPGGMMRA

SEQ ID NO: 201083 - protein, 38 aa, Artificial Sequence
  Description of Artificial Sequence: Synthetic polypeptide
DEEEISCTNPVATEQYGCVCSNWGEDDNAEYFISDTQS

SEQ ID NO: 201084 - protein, 35 aa, Artificial Sequence
  Description of Artificial Sequence: Synthetic polypeptide
DETEIRCTNPIATECWGATTWANAEDLAEPKGPYI

SEQ ID NO: 201085 - protein, 37 aa, Artificial Sequence
  Description of Artificial Sequence: Synthetic polypeptide
CEEEIACTNPVATEQYGSCAAAGNAEGAADSLSGEDA

SEQ ID NO: 201086 - protein, 38 aa, Artificial Sequence
  Description of Artificial Sequence: Synthetic polypeptide
DEEEISTTNPVATEGYGCVCFNWGEAHNTENFGSDTQS

SEQ ID NO: 201087 - protein, 36 aa, Artificial Sequence
  Description of Artificial Sequence: Synthetic polypeptide
DEMQIGTTNPVATEQYGCLCVATDGSPVEFETSDKQ

SEQ ID NO: 201088 - protein, 35 aa, Artificial Sequence
  Description of Artificial Sequence: Synthetic polypeptide
DETEIRCTNPIATECWGATTWANEEDWAEPKGNYI

SEQ ID NO: 201089 - protein, 35 aa, Artificial Sequence
  Description of Artificial Sequence: Synthetic polypeptide
DETEIRTTNPIATECWGATTWANAEDWAEPKGPLI

SEQ ID NO: 201090 - protein, 36 aa, Artificial Sequence
  Description of Artificial Sequence: Synthetic polypeptide
DETEIRTTNPIATECWGATTWANAEDWAEPKGPLIR

SEQ ID NO: 201091 - protein, 35 aa, Artificial Sequence
  Description of Artificial Sequence: Synthetic polypeptide
DETEIRTTNPIATECWGATTWANAEDWAEPQGIQI

SEQ ID NO: 201092 - protein, 35 aa, Artificial Sequence
  Description of Artificial Sequence: Synthetic polypeptide
DETEIRTTNPIATECWGATTWANAEDWAEPPGPYI

SEQ ID NO: 201093 - protein, 37 aa, Artificial Sequence
  Description of Artificial Sequence: Synthetic polypeptide
NEMEIRTTNPVATEQYGCLEPVIHERPEHGFSETPVF

SEQ ID NO: 201094 - protein, 35 aa, Artificial Sequence
  Description of Artificial Sequence: Synthetic polypeptide
DETEIRTTNPIATECWGATTWANAEDWAEPNGPYI

SEQ ID NO: 201095 - protein, 35 aa, Artificial Sequence
  Description of Artificial Sequence: Synthetic polypeptide
DETEIRTTNPIATECWGATTWANAEDWAEPNGPYH

SEQ ID NO: 201096 - protein, 35 aa, Artificial Sequence
  Description of Artificial Sequence: Synthetic polypeptide
DETEIRTTNPIATECWGATTWANAEDWAEPNGPPI

SEQ ID NO: 201097 - protein, 38 aa, Artificial Sequence
  Description of Artificial Sequence: Synthetic polypeptide
AEECISTTNPVATEQYGCVCSNWGEDHDQESFNSDTQS

SEQ ID NO: 201098 - protein, 34 aa, Artificial Sequence
  Description of Artificial Sequence: Synthetic polypeptide
DDSEVASTNPVSTEGYGCVCGTWEHQEYFNSQQA

SEQ ID NO: 201099 - protein, 35 aa, Artificial Sequence
  Description of Artificial Sequence: Synthetic polypeptide
DETEIRTTNPIATECWGATTWANAEDWAEPMGPYI

SEQ ID NO: 201100 - protein, 36 aa, Artificial Sequence
  Description of Artificial Sequence: Synthetic polypeptide
QAEEIATTNPVATEQWGCVAAPHALEAGAPIGIDEE

SEQ ID NO: 201101 - protein, 37 aa, Artificial Sequence
  Description of Artificial Sequence: Synthetic polypeptide
DESAEIATTNPCAYECWGSVATPNGNQQNLEGDHQQQ

SEQ ID NO: 201102 - protein, 35 aa, Artificial Sequence
  Description of Artificial Sequence: Synthetic polypeptide
DETEIRTTNPIATECWGATTWANAEDWAEPLGPYI

SEQ ID NO: 201103 - protein, 34 aa, Artificial Sequence
  Description of Artificial Sequence: Synthetic polypeptide
DDSEVASTNPVSTEGYGCVCQNSAINQEYFGSQQ

SEQ ID NO: 201104 - protein, 37 aa, Artificial Sequence
  Description of Artificial Sequence: Synthetic polypeptide
VEDEIACTNPVAYEQWGSTVCASGDGPQEHQDGNEAK

SEQ ID NO: 201105 - protein, 39 aa, Artificial Sequence
  Description of Artificial Sequence: Synthetic polypeptide
DEDEIACTNPVATEQWGHSVSAMWPAVGTNQGNPMEKVN

SEQ ID NO: 201106 - protein, 37 aa, Artificial Sequence
  Description of Artificial Sequence: Synthetic polypeptide
DESTICTTNPVATEFYGQIVVNDINGLEIGGGDDEDI

SEQ ID NO: 201107 - protein, 35 aa, Artificial Sequence
  Description of Artificial Sequence: Synthetic polypeptide
DETEIATTNPIATECWGATTWAANETWAEPKGPYR

SEQ ID NO: 201108 - protein, 34 aa, Artificial Sequence
  Description of Artificial Sequence: Synthetic polypeptide
DDSEVASTNPVSTEGYGCVCGTWPIQEYFGSQTQ

SEQ ID NO: 201109 - protein, 35 aa, Artificial Sequence
  Description of Artificial Sequence: Synthetic polypeptide
DETEIRTTNPIATECWGATTWANAEDWAEPKGYYI

SEQ ID NO: 201110 - protein, 35 aa, Artificial Sequence
  Description of Artificial Sequence: Synthetic polypeptide
DETEIRTTNPIATECWGACTWANAEDWAEPHGSQI

SEQ ID NO: 201111 - protein, 35 aa, Artificial Sequence
  Description of Artificial Sequence: Synthetic polypeptide
DETEIRTTNPIATECWGATTWANAEDWHEHKGPYI

SEQ ID NO: 201112 - protein, 37 aa, Artificial Sequence
  Description of Artificial Sequence: Synthetic polypeptide
DEEEIACTNPVATEQWGATNCAQNPPVNTAGNPEGTA

SEQ ID NO: 201113 - protein, 35 aa, Artificial Sequence
  Description of Artificial Sequence: Synthetic polypeptide
DENEIATTNPTAYEQWGATYYSIEIEAMNQREMDH

SEQ ID NO: 201114 - protein, 39 aa, Artificial Sequence
  Description of Artificial Sequence: Synthetic polypeptide
DENEISTTNPVATEQYGQCVCSMWGEDHNAEYFNSDNQS

SEQ ID NO: 201115 - protein, 35 aa, Artificial Sequence
  Description of Artificial Sequence: Synthetic polypeptide
DETEIRTTNPIATECWGATTWANAKDWAEPKGPYI

SEQ ID NO: 201116 - protein, 35 aa, Artificial Sequence
  Description of Artificial Sequence: Synthetic polypeptide
DEMEIRTTNPIATECWGATTWHNAEDWSEPQGPQI

SEQ ID NO: 201117 - protein, 35 aa, Artificial Sequence
  Description of Artificial Sequence: Synthetic polypeptide
DENEIATTNPTAYEQWGATYYSIEIEHNQREMDYS

SEQ ID NO: 201118 - protein, 38 aa, Artificial Sequence
  Description of Artificial Sequence: Synthetic polypeptide
AEEEIATTNPVATEGYGQCVCSNWGEDNQEGFGSDTQS

SEQ ID NO: 201119 - protein, 39 aa, Artificial Sequence
  Description of Artificial Sequence: Synthetic polypeptide
DENEISTTNPVATEQYGQCVCGNTGEEHNAENFNSDTQS

SEQ ID NO: 201120 - protein, 35 aa, Artificial Sequence
  Description of Artificial Sequence: Synthetic polypeptide
QEGEIAPTNPCSYEQYGVTVSCCNMFSGTVGGTDR

SEQ ID NO: 201121 - protein, 36 aa, Artificial Sequence
  Description of Artificial Sequence: Synthetic polypeptide
QEGEIAPTNPCSYEQYGVTVSCCNMDSQNSNGGTQR

SEQ ID NO: 201122 - protein, 35 aa, Artificial Sequence
  Description of Artificial Sequence: Synthetic polypeptide
DETEIRTTNPIATECWGATTWANAMDWAEPKGAYI

SEQ ID NO: 201123 - protein, 36 aa, Artificial Sequence
  Description of Artificial Sequence: Synthetic polypeptide
QEGEIAPTNPCSYEQYGVTVSCCNMCSQNSNSGTDR

SEQ ID NO: 201124 - protein, 36 aa, Artificial Sequence
  Description of Artificial Sequence: Synthetic polypeptide
DETEIATTNPVAYEQWGHNEVYYWEEQQHHPKGKED

SEQ ID NO: 201125 - protein, 35 aa, Artificial Sequence
  Description of Artificial Sequence: Synthetic polypeptide
DETEIRTTNPIATECWGATTWANAIDWAEPKGPYI

SEQ ID NO: 201126 - protein, 37 aa, Artificial Sequence
  Description of Artificial Sequence: Synthetic polypeptide
DEEEIATTNPVAYEPYGCTIPNPNVAPQEASINEQTS

SEQ ID NO: 201127 - protein, 35 aa, Artificial Sequence
  Description of Artificial Sequence: Synthetic polypeptide
DETEIRTTNPIATECWGATTWANAIDWAEPKGPYG

SEQ ID NO: 201128 - protein, 35 aa, Artificial Sequence
  Description of Artificial Sequence: Synthetic polypeptide
DETEIRTTNPIATECWGATTWANAIDWAEPEGPYI

SEQ ID NO: 201129 - protein, 35 aa, Artificial Sequence
  Description of Artificial Sequence: Synthetic polypeptide
DEMEIRTTNPIATECWGATTWFNAEDWAEPKGPYI

SEQ ID NO: 201130 - protein, 39 aa, Artificial Sequence
  Description of Artificial Sequence: Synthetic polypeptide
QEGEIATTNPVATEQYGIISFSAPPDTLREPHEGPEDTR

SEQ ID NO: 201131 - protein, 36 aa, Artificial Sequence
  Description of Artificial Sequence: Synthetic polypeptide
DENEIATTNPTAYEQWGATYYSIEIEKINQREMDYR

SEQ ID NO: 201132 - protein, 35 aa, Artificial Sequence
  Description of Artificial Sequence: Synthetic polypeptide
DETEIRTTNPIATECWGATTWANAHDWAEPKGPYI

SEQ ID NO: 201133 - protein, 37 aa, Artificial Sequence
  Description of Artificial Sequence: Synthetic polypeptide
DETEIATTNPVAYEQWGNIICPAVADAGQDHQGDNMA

SEQ ID NO: 201134 - protein, 35 aa, Artificial Sequence
  Description of Artificial Sequence: Synthetic polypeptide
DEMEIRTTNPIATECWGATTWFNAEDWNEPKGPQI

SEQ ID NO: 201135 - protein, 35 aa, Artificial Sequence
  Description of Artificial Sequence: Synthetic polypeptide
DETEIRTTNPIATECWGATTWANAMDWAEPKGPYI

SEQ ID NO: 201136 - protein, 35 aa, Artificial Sequence
  Description of Artificial Sequence: Synthetic polypeptide
DETEIRTTNPIATECWGATTWANAMDWAEPKGPYN

SEQ ID NO: 201137 - protein, 35 aa, Artificial Sequence
  Description of Artificial Sequence: Synthetic polypeptide
DETEIRTTNPIATECWGATTWANANDEAHPNGPYI

SEQ ID NO: 201138 - protein, 39 aa, Artificial Sequence
  Description of Artificial Sequence: Synthetic polypeptide
DENEISTTNPVATEQYGQCVCSNSGEGPNAENFNSDNQA

SEQ ID NO: 201139 - protein, 38 aa, Artificial Sequence
  Description of Artificial Sequence: Synthetic polypeptide
DETEIACTNPVATEQYGSVAGPGGPGGPADAGIGNAMN

SEQ ID NO: 201140 - protein, 36 aa, Artificial Sequence
  Description of Artificial Sequence: Synthetic polypeptide
DETEIRTTNPIATECWGATTWANATDRWAEPKGPYI

SEQ ID NO: 201141 - protein, 35 aa, Artificial Sequence
  Description of Artificial Sequence: Synthetic polypeptide
DETEIRTTNPIATECWGATTWANASDWAEPKGPYI

SEQ ID NO: 201142 - protein, 35 aa, Artificial Sequence
  Description of Artificial Sequence: Synthetic polypeptide
DETEIRTTNPIATECWGATTWANASDCAEPKGPYI

SEQ ID NO: 201143 - protein, 35 aa, Artificial Sequence
  Description of Artificial Sequence: Synthetic polypeptide
DETEIRTTNPIATECWGATTWANARDWAEPKGPYI

SEQ ID NO: 201144 - protein, 39 aa, Artificial Sequence
  Description of Artificial Sequence: Synthetic polypeptide
QEGEIATTNPVATEQYGNCSFSAPFDTLREPHEGLEDTR

SEQ ID NO: 201145 - protein, 36 aa, Artificial Sequence
  Description of Artificial Sequence: Synthetic polypeptide
VEDEIACTNPVATEQWGSVAGEGAPPQATAHGTGMQ

SEQ ID NO: 201146 - protein, 38 aa, Artificial Sequence
  Description of Artificial Sequence: Synthetic polypeptide
VEDEIACTNPVATEQWGHSVSAMWPAGTNQGNPMEPVM

SEQ ID NO: 201147 - protein, 37 aa, Artificial Sequence
  Description of Artificial Sequence: Synthetic polypeptide
MESEIRTTNPVATEQWGNCRTAAYVMDQEPDDHNQDQ

SEQ ID NO: 201148 - protein, 36 aa, Artificial Sequence
  Description of Artificial Sequence: Synthetic polypeptide
DETEIRTTNPIATECWGATTWANAQDWAEPKGDPYI

SEQ ID NO: 201149 - protein, 39 aa, Artificial Sequence
  Description of Artificial Sequence: Synthetic polypeptide
DENEISTTNPVATEQYGQCVCSNSGEDDNAENFNSDTQS

SEQ ID NO: 201150 - protein, 35 aa, Artificial Sequence
  Description of Artificial Sequence: Synthetic polypeptide
DETEIRTTNPIATECWGATTWANAPDWAEPKGPYV

SEQ ID NO: 201151 - protein, 36 aa, Artificial Sequence
  Description of Artificial Sequence: Synthetic polypeptide
DENEIATTNPTAYEQWGATYYSIEIDEMNQRETDYR

SEQ ID NO: 201152 - protein, 37 aa, Artificial Sequence
  Description of Artificial Sequence: Synthetic polypeptide
CDAEIRTTNPVAYEQYGCVCSNWGEHNQENFNSDTQS

SEQ ID NO: 201153 - protein, 35 aa, Artificial Sequence
  Description of Artificial Sequence: Synthetic polypeptide
DETEIRTTNPIATECWGATTWANAPDWAEPKGPYI

SEQ ID NO: 201154 - protein, 35 aa, Artificial Sequence
  Description of Artificial Sequence: Synthetic polypeptide
DETEIRTTNPIATECWGATTWANAPDGAMPKGPYV

SEQ ID NO: 201155 - protein, 35 aa, Artificial Sequence
  Description of Artificial Sequence: Synthetic polypeptide
DEMEIRTTNPIATECWGTTTWANADDPAEPKGPYI

SEQ ID NO: 201156 - protein, 36 aa, Artificial Sequence
  Description of Artificial Sequence: Synthetic polypeptide
DETEIATTNPVAYEQWGCVAGQGPPQQETPDGSVEN

SEQ ID NO: 201157 - protein, 35 aa, Artificial Sequence
  Description of Artificial Sequence: Synthetic polypeptide
DETEIRTTNPIATECWGATTWANANDWAESKGPYI

SEQ ID NO: 201158 - protein, 35 aa, Artificial Sequence
  Description of Artificial Sequence: Synthetic polypeptide
DETEIRTTNPIATECWGATTWANANDWAEPKGPYI

SEQ ID NO: 201159 - protein, 35 aa, Artificial Sequence
  Description of Artificial Sequence: Synthetic polypeptide
DETEIRTTNPIATECWGATTWANANDWAEPKGPYD

SEQ ID NO: 201160 - protein, 35 aa, Artificial Sequence
  Description of Artificial Sequence: Synthetic polypeptide
DETEIRTTNPIATECWGATTWANANDWAEPHGPYI

SEQ ID NO: 201161 - protein, 38 aa, Artificial Sequence
  Description of Artificial Sequence: Synthetic polypeptide
DETEIATTNPVAYEQWGSIICAAVAHAGTDHQGDNMEA

SEQ ID NO: 201162 - protein, 35 aa, Artificial Sequence
  Description of Artificial Sequence: Synthetic polypeptide
DETEIRTTNPIATECWGATTWANATDWAAPKGPYI

SEQ ID NO: 201163 - protein, 39 aa, Artificial Sequence
  Description of Artificial Sequence: Synthetic polypeptide
DDEEIGTTNPVATEQYGQCVCSNWGEDHNAEYFNSETQS

SEQ ID NO: 201164 - protein, 35 aa, Artificial Sequence
  Description of Artificial Sequence: Synthetic polypeptide
DETEIRTTNPIATECWGATTWANAGDWAEPKGPYI

SEQ ID NO: 201165 - protein, 35 aa, Artificial Sequence
  Description of Artificial Sequence: Synthetic polypeptide
DETEIRTTNPIATECWGATTWANAEVWAEPKGPYI

SEQ ID NO: 201166 - protein, 39 aa, Artificial Sequence
  Description of Artificial Sequence: Synthetic polypeptide
DEEEISTTNPVATEQWGQCVCSNWGEDHNQENFGSETQS

SEQ ID NO: 201167 - protein, 35 aa, Artificial Sequence
  Description of Artificial Sequence: Synthetic polypeptide
DETEIRTTNPIATECWGATTWANAEVWAEHKGPYI

SEQ ID NO: 201168 - protein, 34 aa, Artificial Sequence
  Description of Artificial Sequence: Synthetic polypeptide
AESEIASTNPVGYEAYGVVMAYSGLSQEHVGDIH

SEQ ID NO: 201169 - protein, 35 aa, Artificial Sequence
  Description of Artificial Sequence: Synthetic polypeptide
AEEEIATTNPVAYAQWGCVASNGEEAGTPMGEVTW

SEQ ID NO: 201170 - protein, 38 aa, Artificial Sequence
  Description of Artificial Sequence: Synthetic polypeptide
MESEIRTTNPVATEIYGECVCPDTRVPEEQMEGIDVEN

SEQ ID NO: 201171 - protein, 39 aa, Artificial Sequence
  Description of Artificial Sequence: Synthetic polypeptide
QEGEIATTNPVATEQYGNISFSAPDDTWREPHEGLQDTR

SEQ ID NO: 201172 - protein, 37 aa, Artificial Sequence
  Description of Artificial Sequence: Synthetic polypeptide
QAEEIATTNPVATEQYGCVAPGEGGHGINESEEEDNH

SEQ ID NO: 201173 - protein, 39 aa, Artificial Sequence
  Description of Artificial Sequence: Synthetic polypeptide
AEEEIRTTNPVATEGYGQCVCSNWGEDHNQENFNSDTQA

SEQ ID NO: 201174 - protein, 39 aa, Artificial Sequence
  Description of Artificial Sequence: Synthetic polypeptide
AEEEIRTTNPVATEGYGQCVCSNWGEDHNAENFNSENQA

SEQ ID NO: 201175 - protein, 35 aa, Artificial Sequence
  Description of Artificial Sequence: Synthetic polypeptide
DETEIRTTNPIATECWGATTWANAEVWAEPQGPYI

SEQ ID NO: 201176 - protein, 39 aa, Artificial Sequence
  Description of Artificial Sequence: Synthetic polypeptide
QEGEIATTNPVATEQYGNISFSAPDETGREPHEKQEDTR

SEQ ID NO: 201177 - protein, 39 aa, Artificial Sequence
  Description of Artificial Sequence: Synthetic polypeptide
DEEEISTTNPVATEQWGQCVCSNWGEDHNAENFNSDTQQ

SEQ ID NO: 201178 - protein, 35 aa, Artificial Sequence
  Description of Artificial Sequence: Synthetic polypeptide
DETEIRTTNPIATECWGATTWANAETYAEPKGPYI

SEQ ID NO: 201179 - protein, 35 aa, Artificial Sequence
  Description of Artificial Sequence: Synthetic polypeptide
DETEIRTTNPIATECWGATTWANAETWCEPKGPYI

SEQ ID NO: 201180 - protein, 35 aa, Artificial Sequence
  Description of Artificial Sequence: Synthetic polypeptide
DEAAIRTTNPVASACWGSVSRCINNEPDVDDIELL

SEQ ID NO: 201181 - protein, 36 aa, Artificial Sequence
  Description of Artificial Sequence: Synthetic polypeptide
AESEIACTNPVGTEGYGVSCGSGEDLNQEHFGSDQS

SEQ ID NO: 201182 - protein, 38 aa, Artificial Sequence
  Description of Artificial Sequence: Synthetic polypeptide
QEGEIATTNPVATEQYGNISFSAPEDTLREPHEGEDVA

SEQ ID NO: 201183 - protein, 36 aa, Artificial Sequence
  Description of Artificial Sequence: Synthetic polypeptide
DENEIATTNPVATAQWGCVAGEGGEEMNAMLDDNAL

SEQ ID NO: 201184 - protein, 35 aa, Artificial Sequence
  Description of Artificial Sequence: Synthetic polypeptide
DETEIRTTNPIATECWGATTWANAETWAEPKGPYI

SEQ ID NO: 201185 - protein, 38 aa, Artificial Sequence
  Description of Artificial Sequence: Synthetic polypeptide
MEEEIRTTNPVATEGYGTIVQDLFTGDPEGGQGEDEGI

SEQ ID NO: 201186 - protein, 35 aa, Artificial Sequence
  Description of Artificial Sequence: Synthetic polypeptide
DDSEVACTNPVSTEGYGCVCQNSEINQERFGSQQS

SEQ ID NO: 201187 - protein, 39 aa, Artificial Sequence
  Description of Artificial Sequence: Synthetic polypeptide
DEEEISTTNPVATEQWGQCVCSNWGEDHNAENFNSDTQS

SEQ ID NO: 201188 - protein, 35 aa, Artificial Sequence
  Description of Artificial Sequence: Synthetic polypeptide
DETEIRTTNPIATECWGATTWANAEWWAEPKGPHI

SEQ ID NO: 201189 - protein, 35 aa, Artificial Sequence
  Description of Artificial Sequence: Synthetic polypeptide
DETEIRTTNPIATECWGATTWANAEWWAEPKGPYI

SEQ ID NO: 201190 - protein, 36 aa, Artificial Sequence
  Description of Artificial Sequence: Synthetic polypeptide
QEGEIAPTNPCSYEQWGVTVASCLNMLSQGVGGTPR

SEQ ID NO: 201191 - protein, 34 aa, Artificial Sequence
  Description of Artificial Sequence: Synthetic polypeptide
DDSEVACTNPVSTEGYGCVCGTWEIQEYFGSQQG

SEQ ID NO: 201192 - protein, 36 aa, Artificial Sequence
  Description of Artificial Sequence: Synthetic polypeptide
DENCIATVNPVATECYGAVVCIDHQDQEQRQGDTEN

SEQ ID NO: 201193 - protein, 39 aa, Artificial Sequence
  Description of Artificial Sequence: Synthetic polypeptide
DEEEISTTNPVATEQWGQCVCSNWMEDHNAENFNSDNQS

SEQ ID NO: 201194 - protein, 35 aa, Artificial Sequence
  Description of Artificial Sequence: Synthetic polypeptide
DETEIRTTNPIATECWGATTWANAGDWAEPKGPEI

SEQ ID NO: 201195 - protein, 34 aa, Artificial Sequence
  Description of Artificial Sequence: Synthetic polypeptide
DDSEVACTNPVSTEGYGCVCGTWEPNQEYFGSQQ

SEQ ID NO: 201196 - protein, 36 aa, Artificial Sequence
  Description of Artificial Sequence: Synthetic polypeptide
AESEIACTNPVGTEGYGVSCGSEPHNQEHFGSDNQA

SEQ ID NO: 201197 - protein, 37 aa, Artificial Sequence
  Description of Artificial Sequence: Synthetic polypeptide
TEECIRTTNPTATECYGQCISCTQEEPSQFLGGMEDP

SEQ ID NO: 201198 - protein, 36 aa, Artificial Sequence
  Description of Artificial Sequence: Synthetic polypeptide
DENEIATTNPTAYEQWGATYYSIEIEKNQREMDMYR

SEQ ID NO: 201199 - protein, 37 aa, Artificial Sequence
  Description of Artificial Sequence: Synthetic polypeptide
MESEIRTTNPVATEQWGMVVDNEEGEEMNNGEGDGAQ

SEQ ID NO: 201200 - protein, 39 aa, Artificial Sequence
  Description of Artificial Sequence: Synthetic polypeptide
QEGEIATTNPVATEQYGNISFSAPDDTDREPHEGFEDTR

SEQ ID NO: 201201 - protein, 38 aa, Artificial Sequence
  Description of Artificial Sequence: Synthetic polypeptide
DETEIATTNPVAYEQWGSVCSPANPALPGEHMIDLTAM

SEQ ID NO: 201202 - protein, 36 aa, Artificial Sequence
  Description of Artificial Sequence: Synthetic polypeptide
DENEIATTNPTAYEQWGATYYSIEIENMNQNEMDYR

SEQ ID NO: 201203 - protein, 39 aa, Artificial Sequence
  Description of Artificial Sequence: Synthetic polypeptide
DEEEISTTNPVATEQYGCQVCSNWGEDHNQEHFMSDTQS

SEQ ID NO: 201204 - protein, 38 aa, Artificial Sequence
  Description of Artificial Sequence: Synthetic polypeptide
DDEEIGTTNPVATCQYGCVCSNWGEGDNAENFSSDNQS

SEQ ID NO: 201205 - protein, 38 aa, Artificial Sequence
  Description of Artificial Sequence: Synthetic polypeptide
MESEIRTTNPVATEQWGCVVDNNEEGEEMNAGEGDGAQ

SEQ ID NO: 201206 - protein, 35 aa, Artificial Sequence
  Description of Artificial Sequence: Synthetic polypeptide
DETEIRTTNPIATECWGATTWANAFDWAEPKGPYI

SEQ ID NO: 201207 - protein, 35 aa, Artificial Sequence
  Description of Artificial Sequence: Synthetic polypeptide
DETEIRTTNPIATECWGATTWANAEYWAEPKGPYI

SEQ ID NO: 201208 - protein, 38 aa, Artificial Sequence
  Description of Artificial Sequence: Synthetic polypeptide
MESEIRTTNPVATEIYGQCVCPDTRVPEEQQMEGGVEN

SEQ ID NO: 201209 - protein, 37 aa, Artificial Sequence
  Description of Artificial Sequence: Synthetic polypeptide
DENEIATTNPTAYEQWGATYYSIEIESMNQREMDMDR

SEQ ID NO: 201210 - protein, 35 aa, Artificial Sequence
  Description of Artificial Sequence: Synthetic polypeptide
AESEIACTNPVGTEGYGVSCGSGEAHNQHFGSDQS

SEQ ID NO: 201211 - protein, 35 aa, Artificial Sequence
  Description of Artificial Sequence: Synthetic polypeptide
DETEIRTTNPIATECWGATTWANAEYWAEPDGPYI

SEQ ID NO: 201212 - protein, 37 aa, Artificial Sequence
  Description of Artificial Sequence: Synthetic polypeptide
DEDEIATTNPVAYEPWGHNVATPAHQGGADSDGNAVE

SEQ ID NO: 201213 - protein, 36 aa, Artificial Sequence
  Description of Artificial Sequence: Synthetic polypeptide
DENEIATTNPTAYEQWGATYYSMEHIEMNQREMDYR

SEQ ID NO: 201214 - protein, 35 aa, Artificial Sequence
  Description of Artificial Sequence: Synthetic polypeptide
DETEIRTTNPIATECWGATTWANAHDWAEPKGPEI

SEQ ID NO: 201215 - protein, 36 aa, Artificial Sequence
  Description of Artificial Sequence: Synthetic polypeptide
DEDEIATTNPVAYEPWGHNGATPAHQGADSDGNAME

SEQ ID NO: 201216 - protein, 35 aa, Artificial Sequence
  Description of Artificial Sequence: Synthetic polypeptide
DETEIRTTNPIATECWGATTWANATDWAEPKGPYI

SEQ ID NO: 201217 - protein, 35 aa, Artificial Sequence
  Description of Artificial Sequence: Synthetic polypeptide
DETEIRTTNPIATECWGATTWANATDWAEPMGPYG

SEQ ID NO: 201218 - protein, 35 aa, Artificial Sequence
  Description of Artificial Sequence: Synthetic polypeptide
DETEIRTTNPIATECWGATTWANNEYWAEPKGPYI

SEQ ID NO: 201219 - protein, 38 aa, Artificial Sequence
  Description of Artificial Sequence: Synthetic polypeptide
CDAEIRTTNPVATEQYGCVCSNWGEDHNAENFNSDTQA

SEQ ID NO: 201220 - protein, 35 aa, Artificial Sequence
  Description of Artificial Sequence: Synthetic polypeptide
DETEIRTTNPIATECWGATTWANNEDWAEPKGPYI

SEQ ID NO: 201221 - protein, 39 aa, Artificial Sequence
  Description of Artificial Sequence: Synthetic polypeptide
DEEEIRTTNPVAYEQYGQCVCGNWGEDHNAENFNSETQA

SEQ ID NO: 201222 - protein, 39 aa, Artificial Sequence
  Description of Artificial Sequence: Synthetic polypeptide
DENEISTTNPVATEQYGQCVCSNWGEDHNAENFGSDTQS

SEQ ID NO: 201223 - protein, 35 aa, Artificial Sequence
  Description of Artificial Sequence: Synthetic polypeptide
DETEIRTTNPIATECWGATTWANMEDWAEPKGPYI

SEQ ID NO: 201224 - protein, 35 aa, Artificial Sequence
  Description of Artificial Sequence: Synthetic polypeptide
DETEIRTTNPIATECWGATTWANMEDWAEPKGPWI

SEQ ID NO: 201225 - protein, 36 aa, Artificial Sequence
  Description of Artificial Sequence: Synthetic polypeptide
DETEIRTTNPIATECWGATTWANMEDIQAEPNGPYI

SEQ ID NO: 201226 - protein, 39 aa, Artificial Sequence
  Description of Artificial Sequence: Synthetic polypeptide
DEEEISTTNPVATEEYGQCVCSNWGEDHNQENFNSDTQA

SEQ ID NO: 201227 - protein, 38 aa, Artificial Sequence
  Description of Artificial Sequence: Synthetic polypeptide
DETEIACTNPVATEQYGSTACAANHGLPLASAENNDEE

SEQ ID NO: 201228 - protein, 37 aa, Artificial Sequence
  Description of Artificial Sequence: Synthetic polypeptide
TEDEIRTTNPSAYEAWGSTVVYMQALSQTEEGTNADT

SEQ ID NO: 201229 - protein, 39 aa, Artificial Sequence
  Description of Artificial Sequence: Synthetic polypeptide
DEEEIRTTNPVAYEQYGQCVCGNWGEDHNAENFMSDTQS

SEQ ID NO: 201230 - protein, 38 aa, Artificial Sequence
  Description of Artificial Sequence: Synthetic polypeptide
DEAEIRCTNPVATEQYGCVCSNWGEDHNDEHFISDTQS

SEQ ID NO: 201231 - protein, 36 aa, Artificial Sequence
  Description of Artificial Sequence: Synthetic polypeptide
DETEIRTTNPIATECWGATTWANLEDWAEPKGGPYI

SEQ ID NO: 201232 - protein, 39 aa, Artificial Sequence
  Description of Artificial Sequence: Synthetic polypeptide
DEEEIRTTNPVAYEQYGQCVCSMWGEDHNQENFISETQA

SEQ ID NO: 201233 - protein, 35 aa, Artificial Sequence
  Description of Artificial Sequence: Synthetic polypeptide
DETEIRTTNPIATECWGATTWANKEFWAEPKGPYI

SEQ ID NO: 201234 - protein, 37 aa, Artificial Sequence
  Description of Artificial Sequence: Synthetic polypeptide
DEQEIATTNPVATEQWGNPVATGGGHGPESMGGEQAD

SEQ ID NO: 201235 - protein, 37 aa, Artificial Sequence
  Description of Artificial Sequence: Synthetic polypeptide
CEDEIACTNPVATEQYGCTACAGANGLQEDALEGEMW

SEQ ID NO: 201236 - protein, 37 aa, Artificial Sequence
  Description of Artificial Sequence: Synthetic polypeptide
DETEIACTNPVATEQYGSCANAGDPIGNNHADDMNDM

SEQ ID NO: 201237 - protein, 35 aa, Artificial Sequence
  Description of Artificial Sequence: Synthetic polypeptide
QENEIATTNPVAYEPYGYNSSGEHLNQNHMEMQLN

SEQ ID NO: 201238 - protein, 35 aa, Artificial Sequence
  Description of Artificial Sequence: Synthetic polypeptide
DETEIRTTNPIATECWGATTWANKEEWAEPKGPYI

SEQ ID NO: 201239 - protein, 36 aa, Artificial Sequence
  Description of Artificial Sequence: Synthetic polypeptide
DEAAILTTNPVASACWGSVSRWINNEPDVTDGENLN

SEQ ID NO: 201240 - protein, 37 aa, Artificial Sequence
  Description of Artificial Sequence: Synthetic polypeptide
DEMEIGTTNPVATCQYGQCVCSWGEHNEENFISDTQS

SEQ ID NO: 201241 - protein, 35 aa, Artificial Sequence
  Description of Artificial Sequence: Synthetic polypeptide
QEEEIATTNPVAYEWYGTHAPWCEHEFSQHNEGEW

SEQ ID NO: 201242 - protein, 36 aa, Artificial Sequence
  Description of Artificial Sequence: Synthetic polypeptide
DEEEIATTNPVAYEPWGHSACAAANGSAMMGGDQHQ

SEQ ID NO: 201243 - protein, 35 aa, Artificial Sequence
  Description of Artificial Sequence: Synthetic polypeptide
DETEIRTTNPIATECWGATTWANPEDWAEPKGPYI

SEQ ID NO: 201244 - protein, 34 aa, Artificial Sequence
  Description of Artificial Sequence: Synthetic polypeptide
TEDEIASVNPVCYEPYGVTVNTWDLSTAAGGNNV

SEQ ID NO: 201245 - protein, 39 aa, Artificial Sequence
  Description of Artificial Sequence: Synthetic polypeptide
DEEEIRTTNPVAYEQYGQCVCQNWGEDHNAEYFDSDNQS

SEQ ID NO: 201246 - protein, 35 aa, Artificial Sequence
  Description of Artificial Sequence: Synthetic polypeptide
DETEIRTTNPIATECWGATTWANTEDKAEPKGPYI

SEQ ID NO: 201247 - protein, 39 aa, Artificial Sequence
  Description of Artificial Sequence: Synthetic polypeptide
DEEEIRTTNPVAYEQYGQCVCSMWEEDHNQENFISDTQS

SEQ ID NO: 201248 - protein, 39 aa, Artificial Sequence
  Description of Artificial Sequence: Synthetic polypeptide
MEEEIRTTNPVATEAYGAVVNMQGINNMDNQTGEFTEEG

SEQ ID NO: 201249 - protein, 39 aa, Artificial Sequence
  Description of Artificial Sequence: Synthetic polypeptide
QEEEIRTTNPVATDQYGMITVGNMGMEDINEEGGNEGNG

SEQ ID NO: 201250 - protein, 34 aa, Artificial Sequence
  Description of Artificial Sequence: Synthetic polypeptide
DENEIATTNPIATECWGATTWANAEDWAEPKGPI

SEQ ID NO: 201251 - protein, 39 aa, Artificial Sequence
  Description of Artificial Sequence: Synthetic polypeptide
DEEEIRTTNPVAYEQYGQCVCGTWGEDHNAEYFDSDTQS

SEQ ID NO: 201252 - protein, 36 aa, Artificial Sequence
  Description of Artificial Sequence: Synthetic polypeptide
VEDEIATTNPVAYEQWGSVCAQATPGNPAGVPLQDD

SEQ ID NO: 201253 - protein, 39 aa, Artificial Sequence
  Description of Artificial Sequence: Synthetic polypeptide
DENEISTTNPVATEQYGQCVCSNWGEDHNAENFNSDTQS

SEQ ID NO: 201254 - protein, 36 aa, Artificial Sequence
  Description of Artificial Sequence: Synthetic polypeptide
DETEIRTTNPIATECWGATTWANSEDWTAEPKGPYI

SEQ ID NO: 201255 - protein, 35 aa, Artificial Sequence
  Description of Artificial Sequence: Synthetic polypeptide
DETEIRTTNPIATECWGATTWANSEDWAEPKGPYI

SEQ ID NO: 201256 - protein, 38 aa, Artificial Sequence
  Description of Artificial Sequence: Synthetic polypeptide
AEECISTTNPVATEQYGCVCSNWGEDHNAENFNSDTQS

SEQ ID NO: 201257 - protein, 35 aa, Artificial Sequence
  Description of Artificial Sequence: Synthetic polypeptide
DETEIRTTNPIATECWGATTWANSEDWAEPKGPDI

SEQ ID NO: 201258 - protein, 35 aa, Artificial Sequence
  Description of Artificial Sequence: Synthetic polypeptide
DETEIRTTNPIATECWGATTWANSEDCAEPKGPYI

SEQ ID NO: 201259 - protein, 39 aa, Artificial Sequence
  Description of Artificial Sequence: Synthetic polypeptide
DENEISTTNPVATEQYGQCVCSNWGEDNNEENFNSDNQA

SEQ ID NO: 201260 - protein, 35 aa, Artificial Sequence
  Description of Artificial Sequence: Synthetic polypeptide
DETEIRTTNPIATECWGATTWANREDWAEPKGPYI

SEQ ID NO: 201261 - protein, 39 aa, Artificial Sequence
  Description of Artificial Sequence: Synthetic polypeptide
MESEIRTTNPVATEQYGAVFVPNTDAEEWPQPIGQEEPQ

SEQ ID NO: 201262 - protein, 35 aa, Artificial Sequence
  Description of Artificial Sequence: Synthetic polypeptide
QEEEIATTNPVAYEPYGEHAPWCEHEASQHAEGEW

SEQ ID NO: 201263 - protein, 35 aa, Artificial Sequence
  Description of Artificial Sequence: Synthetic polypeptide
DETEIRTTNPIATECWGATTWANQEDWAEPKGPYI

SEQ ID NO: 201264 - protein, 37 aa, Artificial Sequence
  Description of Artificial Sequence: Synthetic polypeptide
AEEEIATTNPVATEGYGCYCGTWGEDNAEHFNSETQA

SEQ ID NO: 201265 - protein, 38 aa, Artificial Sequence
  Description of Artificial Sequence: Synthetic polypeptide
DENEISTTNPVATEQYGQCVCSNWGEHNEENFISDTAS

SEQ ID NO: 201266 - protein, 35 aa, Artificial Sequence
  Description of Artificial Sequence: Synthetic polypeptide
DETEIRTTNPIATECWGATTWANPEDWIEPKGPYI

SEQ ID NO: 201267 - protein, 37 aa, Artificial Sequence
  Description of Artificial Sequence: Synthetic polypeptide
QENEIATTNPVAYEPYGYNVPSGENHLNQNHMEMQLN

SEQ ID NO: 201268 - protein, 39 aa, Artificial Sequence
  Description of Artificial Sequence: Synthetic polypeptide
DDEEIGTTNPVATEQYGQCVCSNWGEDHNAENFISENQS

SEQ ID NO: 201269 - protein, 35 aa, Artificial Sequence
  Description of Artificial Sequence: Synthetic polypeptide
DETEIRTTNPIATECWGATTWANKEDWAEPKGPYI

SEQ ID NO: 201270 - protein, 35 aa, Artificial Sequence
  Description of Artificial Sequence: Synthetic polypeptide
DETEIRTTNPIATECWGATTWANIEDWAEPKGPYI

SEQ ID NO: 201271 - protein, 35 aa, Artificial Sequence
  Description of Artificial Sequence: Synthetic polypeptide
DETEIRTTNPIATECWGATTWANDTDWAEPKGPYI

SEQ ID NO: 201272 - protein, 35 aa, Artificial Sequence
  Description of Artificial Sequence: Synthetic polypeptide
DETEIRTTNPIATECWGATTWANDEPWAEPKGPYI

SEQ ID NO: 201273 - protein, 35 aa, Artificial Sequence
  Description of Artificial Sequence: Synthetic polypeptide
DETEIRTTNPIATECWGATTWANDEDWAEPKRPYI

SEQ ID NO: 201274 - protein, 35 aa, Artificial Sequence
  Description of Artificial Sequence: Synthetic polypeptide
DETEIRTTNPIATECWGATTWANDEDWAEPKGPYI

SEQ ID NO: 201275 - protein, 39 aa, Artificial Sequence
  Description of Artificial Sequence: Synthetic polypeptide
MEEEIRTTNPVATEFYGVSVNMQGINNMDNETGEFTEEG

SEQ ID NO: 201276 - protein, 35 aa, Artificial Sequence
  Description of Artificial Sequence: Synthetic polypeptide
QAEEIATTNPVAYEQWGCTAGNNLVATMADGAEAW

SEQ ID NO: 201277 - protein, 35 aa, Artificial Sequence
  Description of Artificial Sequence: Synthetic polypeptide
DETEIRTTNPIATECWGATTWANCENEAEPKGPYG

SEQ ID NO: 201278 - protein, 35 aa, Artificial Sequence
  Description of Artificial Sequence: Synthetic polypeptide
DETEIRTTNPIATECWGATTWANCEDWAEPKGPYI

SEQ ID NO: 201279 - protein, 35 aa, Artificial Sequence
  Description of Artificial Sequence: Synthetic polypeptide
DETEIRTTNPIATECWGATTWANCEDWAEPKGPYC

SEQ ID NO: 201280 - protein, 39 aa, Artificial Sequence
  Description of Artificial Sequence: Synthetic polypeptide
DEEEIRTTNPVAYEQYGQCTCSNWEEDDNAEYINSDTQA

SEQ ID NO: 201281 - protein, 35 aa, Artificial Sequence
  Description of Artificial Sequence: Synthetic polypeptide
DETEIRTTNPIATECWGATTWANEEDWAEPKGPYI

SEQ ID NO: 201282 - protein, 35 aa, Artificial Sequence
  Description of Artificial Sequence: Synthetic polypeptide
DETEIRTTNPIATECWGATTWANCEDEAEPKGPYG

SEQ ID NO: 201283 - protein, 39 aa, Artificial Sequence
  Description of Artificial Sequence: Synthetic polypeptide
AEEEIRTTNPVATEQFGQCVCSTWGYDDNAEHFISDTQS

SEQ ID NO: 201284 - protein, 36 aa, Artificial Sequence
  Description of Artificial Sequence: Synthetic polypeptide
QEEEIATTNPVAYEPQWGCVAGTGPVATMADGQAAE

SEQ ID NO: 201285 - protein, 35 aa, Artificial Sequence
  Description of Artificial Sequence: Synthetic polypeptide
DENEIATTNPTAYEQWGATYYSHEIEMNQREMDYG

SEQ ID NO: 201286 - protein, 39 aa, Artificial Sequence
  Description of Artificial Sequence: Synthetic polypeptide
DEEEISTTNPVATEEYGQCVCSNWMEDHNAENFNSDTQS

SEQ ID NO: 201287 - protein, 35 aa, Artificial Sequence
  Description of Artificial Sequence: Synthetic polypeptide
DETEIRTTNPIATECWGATTWANAYDWAEPKGPYI

SEQ ID NO: 201288 - protein, 35 aa, Artificial Sequence
  Description of Artificial Sequence: Synthetic polypeptide
DETEIRTTNPIATECWGATTWANAWDWAEPKGPYI

SEQ ID NO: 201289 - protein, 35 aa, Artificial Sequence
  Description of Artificial Sequence: Synthetic polypeptide
DETEIRTTNPIATECWGATTWANAVDWKEPKGPYI

SEQ ID NO: 201290 - protein, 38 aa, Artificial Sequence
  Description of Artificial Sequence: Synthetic polypeptide
TEECIATTNPVATEQYGCVCSNSGEDHNAEYFLSDTQS

SEQ ID NO: 201291 - protein, 35 aa, Artificial Sequence
  Description of Artificial Sequence: Synthetic polypeptide
DETEIRTTNPIATECWGATTWANAVDWAEPKGTYI

SEQ ID NO: 201292 - protein, 35 aa, Artificial Sequence
  Description of Artificial Sequence: Synthetic polypeptide
DETEIRTTNPIATECWGATTWANAVDWAEPKGPYI

SEQ ID NO: 201293 - protein, 37 aa, Artificial Sequence
  Description of Artificial Sequence: Synthetic polypeptide
DENEIATTNPVAYEQWGSACSVAPHLNNEAPGGEAVH

SEQ ID NO: 201294 - protein, 36 aa, Artificial Sequence
  Description of Artificial Sequence: Synthetic polypeptide
DETEIRTTNPIATECWGATTWANEEDWLAEPKGPYI

SEQ ID NO: 201295 - protein, 39 aa, Artificial Sequence
  Description of Artificial Sequence: Synthetic polypeptide
DEMEIRTTNPVATCQYGQCVCSNWGEDDNAENFNSDNQA

SEQ ID NO: 201296 - protein, 35 aa, Artificial Sequence
  Description of Artificial Sequence: Synthetic polypeptide
DETEIRTTNPIATECWGATTWANFEDWAAPKGPYI

SEQ ID NO: 201297 - protein, 36 aa, Artificial Sequence
  Description of Artificial Sequence: Synthetic polypeptide
VEDEIATTNPVAYEQWGSVCAMANPALNAHEDLAAM

SEQ ID NO: 201298 - protein, 35 aa, Artificial Sequence
  Description of Artificial Sequence: Synthetic polypeptide
DETEIRTTNPIATECWGATTWANHEDWAEVKGPYI

SEQ ID NO: 201299 - protein, 35 aa, Artificial Sequence
  Description of Artificial Sequence: Synthetic polypeptide
DETEIRTTNPIATECWGATTWANHEDWAEPKGPYI

SEQ ID NO: 201300 - protein, 39 aa, Artificial Sequence
  Description of Artificial Sequence: Synthetic polypeptide
DEEEISTTNPVATEEYGQCVCSNWGEDPNAENFNSDTQS

SEQ ID NO: 201301 - protein, 38 aa, Artificial Sequence
  Description of Artificial Sequence: Synthetic polypeptide
AEEEIATTNPVATEGYGCVCSVWGEDDNAEGFNSDTQS

SEQ ID NO: 201302 - protein, 38 aa, Artificial Sequence
  Description of Artificial Sequence: Synthetic polypeptide
NEREIRTTNPVATEQYGCVCQNWGEDHNIEYFISDTQS

SEQ ID NO: 201303 - protein, 38 aa, Artificial Sequence
  Description of Artificial Sequence: Synthetic polypeptide
DEMEIRTTNPVATCQYGQCVCNNWGEDNAENFGSDTQS

SEQ ID NO: 201304 - protein, 38 aa, Artificial Sequence
  Description of Artificial Sequence: Synthetic polypeptide
TEDEIRTTNPVAYEQWGVACYTGDNLHMDQNTQGQDDD

SEQ ID NO: 201305 - protein, 38 aa, Artificial Sequence
  Description of Artificial Sequence: Synthetic polypeptide
AEECISTTNPVATEQYGCVCSNWGEDHNQENFGSDTQS

SEQ ID NO: 201306 - protein, 39 aa, Artificial Sequence
  Description of Artificial Sequence: Synthetic polypeptide
DEEEIRTTNPVAYEQYGQCVCGNWEEDHNAENFNSDNQA

SEQ ID NO: 201307 - protein, 37 aa, Artificial Sequence
  Description of Artificial Sequence: Synthetic polypeptide
DETEIACTNPVATEQYGSCALAGDPIGNNHADDFNDD

SEQ ID NO: 201308 - protein, 35 aa, Artificial Sequence
  Description of Artificial Sequence: Synthetic polypeptide
DETEIRTTNPIATECWGATTWANHEDTAEPKGPYI

SEQ ID NO: 201309 - protein, 35 aa, Artificial Sequence
  Description of Artificial Sequence: Synthetic polypeptide
DETEIRTTNPIATECWGATTWANHEDKAEPKGPYI

SEQ ID NO: 201310 - protein, 36 aa, Artificial Sequence
  Description of Artificial Sequence: Synthetic polypeptide
TEDEIRTTNPVSYHAWGSTVFCMQALSQTHSGTNDT

SEQ ID NO: 201311 - protein, 35 aa, Artificial Sequence
  Description of Artificial Sequence: Synthetic polypeptide
DETEIRTTNPIATECWGATTWANGEDWAEPKGPYI

SEQ ID NO: 201312 - protein, 37 aa, Artificial Sequence
  Description of Artificial Sequence: Synthetic polypeptide
DETEIACTNPVATEQYGSTCAGVTHAGAGAGIGIEAD

SEQ ID NO: 201313 - protein, 35 aa, Artificial Sequence
  Description of Artificial Sequence: Synthetic polypeptide
DETEIRTTNPIATECWGATTWANFEDWAEPKGPYI

SEQ ID NO: 201314 - protein, 34 aa, Artificial Sequence
  Description of Artificial Sequence: Synthetic polypeptide
QEQEIATTNPVATASWGCVAGEGEEMNAALDNDD

SEQ ID NO: 201315 - protein, 36 aa, Artificial Sequence
  Description of Artificial Sequence: Synthetic polypeptide
DETEIATTNPVAYEPWGHSACAAANGDAYQGGDQHK

SEQ ID NO: 201316 - protein, 35 aa, Artificial Sequence
  Description of Artificial Sequence: Synthetic polypeptide
DETEIRTTNPIATECWGATTWANFEDWAEGKGPYI

SEQ ID NO: 201317 - protein, 34 aa, Artificial Sequence
  Description of Artificial Sequence: Synthetic polypeptide
DETEIATTNPVAYEPWGPTAGQGGGQEHQNNTSN

SEQ ID NO: 201318 - protein, 38 aa, Artificial Sequence
  Description of Artificial Sequence: Synthetic polypeptide
DENCIRTTNPVATEIYGCVCSNWGEDHNAENFNSDTQA

SEQ ID NO: 201319 - protein, 36 aa, Artificial Sequence
  Description of Artificial Sequence: Synthetic polypeptide
DEMEIRTTNPIATECWGNATTWANAEDWAEPKGPYI

SEQ ID NO: 201320 - protein, 36 aa, Artificial Sequence
  Description of Artificial Sequence: Synthetic polypeptide
TEDEIRTTNPVAYEAWGSTVVMQAISQTHEGTKADT

SEQ ID NO: 201321 - protein, 36 aa, Artificial Sequence
  Description of Artificial Sequence: Synthetic polypeptide
DENEIATTNPVATAQWGCVAGEGVEEMNMALMDNKM

SEQ ID NO: 201322 - protein, 35 aa, Artificial Sequence
  Description of Artificial Sequence: Synthetic polypeptide
DETEIRTTNPIATECWGATTWANAETWAEPFGPYI

SEQ ID NO: 201323 - protein, 35 aa, Artificial Sequence
  Description of Artificial Sequence: Synthetic polypeptide
DETEIRTTNPIATECWGATTWANAESWSEPKGPYI

SEQ ID NO: 201324 - protein, 38 aa, Artificial Sequence
  Description of Artificial Sequence: Synthetic polypeptide
DETEIACTNPVAYEQYGSACPATNPHHEAEAPGGNMNN

SEQ ID NO: 201325 - protein, 37 aa, Artificial Sequence
  Description of Artificial Sequence: Synthetic polypeptide
DENEIRTTNPVSTEVYGTVQTSPMDAIEIQQNDAHHD

SEQ ID NO: 201326 - protein, 38 aa, Artificial Sequence
  Description of Artificial Sequence: Synthetic polypeptide
DETEIACTNPVAYEQYGSACSPANDTLGVPDAEEGKMW

SEQ ID NO: 201327 - protein, 35 aa, Artificial Sequence
  Description of Artificial Sequence: Synthetic polypeptide
AESEIACTNPVAYEGYGEATACETALSQTVGGDDC

SEQ ID NO: 201328 - protein, 35 aa, Artificial Sequence
  Description of Artificial Sequence: Synthetic polypeptide
QENEIATTNPVAYAPYGNTSGNNHLNQNHMEMQLN

SEQ ID NO: 201329 - protein, 36 aa, Artificial Sequence
  Description of Artificial Sequence: Synthetic polypeptide
CAEEIATTNPVATASWGSVSATGAGGTAPQDIADFH

SEQ ID NO: 201330 - protein, 38 aa, Artificial Sequence
  Description of Artificial Sequence: Synthetic polypeptide
CEAEISTTNPVATEGYGQCVCSNWGEHNAENFGSDNQA

SEQ ID NO: 201331 - protein, 37 aa, Artificial Sequence
  Description of Artificial Sequence: Synthetic polypeptide
CAEEIACTNPVAYEQWGSVCSPVNPAQQEHQDGTEMK

SEQ ID NO: 201332 - protein, 37 aa, Artificial Sequence
  Description of Artificial Sequence: Synthetic polypeptide
CAEEIACTNPVAYEQWGSVCSANPAQPQEHQDGTAMK

SEQ ID NO: 201333 - protein, 35 aa, Artificial Sequence
  Description of Artificial Sequence: Synthetic polypeptide
DETEIRTTNPIATECWGATTWANAEDWTEPKGPYI

SEQ ID NO: 201334 - protein, 35 aa, Artificial Sequence
  Description of Artificial Sequence: Synthetic polypeptide
AESEIACTNPVAYEGYGEATACETGALSQTVGGDN

SEQ ID NO: 201335 - protein, 37 aa, Artificial Sequence
  Description of Artificial Sequence: Synthetic polypeptide
CAEEIACTNPVAYEQWGHSVCSANPAQQEHQDGTEMK

SEQ ID NO: 201336 - protein, 37 aa, Artificial Sequence
  Description of Artificial Sequence: Synthetic polypeptide
VEDEIACTNPVATEQYGSACAANPELGQEHQDDQTAQ

SEQ ID NO: 201337 - protein, 37 aa, Artificial Sequence
  Description of Artificial Sequence: Synthetic polypeptide
VEDEIATTNPVAYEQWGSVCSPANPALTEHMIDLTAM

SEQ ID NO: 201338 - protein, 38 aa, Artificial Sequence
  Description of Artificial Sequence: Synthetic polypeptide
AEECISTTNPVATEQYGCVCSNWGEDHNAENFNSDTQL

SEQ ID NO: 201339 - protein, 38 aa, Artificial Sequence
  Description of Artificial Sequence: Synthetic polypeptide
AEECISTTNPVATEQYGCVCSNWGEDHNAENFNSDTQA

SEQ ID NO: 201340 - protein, 37 aa, Artificial Sequence
  Description of Artificial Sequence: Synthetic polypeptide
DEEEIACTNPVATEQYGSCAAAGYPPFDDPEIENGEE

SEQ ID NO: 201341 - protein, 38 aa, Artificial Sequence
  Description of Artificial Sequence: Synthetic polypeptide
DETEIACTNPVAYEQYGSACSPANPTHAGEAGAEMNEN

SEQ ID NO: 201342 - protein, 36 aa, Artificial Sequence
  Description of Artificial Sequence: Synthetic polypeptide
DETEIRTTNPIATECWGATTWANAEDWTARPKGPYI

SEQ ID NO: 201343 - protein, 36 aa, Artificial Sequence
  Description of Artificial Sequence: Synthetic polypeptide
DETEIACTNPVAYEQYGSCAAAGGNHGNAEGVGMHN

SEQ ID NO: 201344 - protein, 34 aa, Artificial Sequence
  Description of Artificial Sequence: Synthetic polypeptide
QENEIATTNPVAYEPWGPNVAGEGLQNHMEMQLH

SEQ ID NO: 201345 - protein, 37 aa, Artificial Sequence
  Description of Artificial Sequence: Synthetic polypeptide
DEDEIRATNPVATEQWGGCNAINNHEEAAGMEMWARE

SEQ ID NO: 201346 - protein, 39 aa, Artificial Sequence
  Description of Artificial Sequence: Synthetic polypeptide
DEEEISTTNPVATEGFGQCVCSTWGYDDNAEHFGSDTQS

SEQ ID NO: 201347 - protein, 37 aa, Artificial Sequence
  Description of Artificial Sequence: Synthetic polypeptide
AESSEAIATTNPVAYEQWGVVYHWNNDQADDRTGQQM

SEQ ID NO: 201348 - protein, 35 aa, Artificial Sequence
  Description of Artificial Sequence: Synthetic polypeptide
DETEIRTTNPIATECWGATTWANAEDWTEPKGRYI

SEQ ID NO: 201349 - protein, 35 aa, Artificial Sequence
  Description of Artificial Sequence: Synthetic polypeptide
DETEIRTTNPIATECWGATTWANAEDWVEPKGPYI

SEQ ID NO: 201350 - protein, 38 aa, Artificial Sequence
  Description of Artificial Sequence: Synthetic polypeptide
AEEEIRTTNPVATEGFGQCVCSNWGYDNAEHFNSDTQS

SEQ ID NO: 201351 - protein, 35 aa, Artificial Sequence
  Description of Artificial Sequence: Synthetic polypeptide
DETEIRTTNPIATECWGATTWANAEDYAEPKGPYI

SEQ ID NO: 201352 - protein, 36 aa, Artificial Sequence
  Description of Artificial Sequence: Synthetic polypeptide
NENAEIASTNPVAYECWGVVAPTIDNDMDHREGGSR

SEQ ID NO: 201353 - protein, 35 aa, Artificial Sequence
  Description of Artificial Sequence: Synthetic polypeptide
DEGEIRTTNPIATECWGATTWANAEDWAEPKGPYI

SEQ ID NO: 201354 - protein, 38 aa, Artificial Sequence
  Description of Artificial Sequence: Synthetic polypeptide
AEEEIRTTNPVATEEYGQCSCSWGEAHNAENFISDTQA

SEQ ID NO: 201355 - protein, 37 aa, Artificial Sequence
  Description of Artificial Sequence: Synthetic polypeptide
VEDEIACTNPVATEQYGSACAANPELGGEHQDDQFAH

SEQ ID NO: 201356 - protein, 38 aa, Artificial Sequence
  Description of Artificial Sequence: Synthetic polypeptide
QENEIRTTNPVATEQWGAVVDNGEEGEEMNAGEGVGEQ

SEQ ID NO: 201357 - protein, 35 aa, Artificial Sequence
  Description of Artificial Sequence: Synthetic polypeptide
DDSEVASTNPVSYEGYGNVACNTEISQSRTGGQNE

SEQ ID NO: 201358 - protein, 37 aa, Artificial Sequence
  Description of Artificial Sequence: Synthetic polypeptide
CAEEIATTNPVATEQYGCVAPGEGGHGQNESAEEAEN

SEQ ID NO: 201359 - protein, 38 aa, Artificial Sequence
  Description of Artificial Sequence: Synthetic polypeptide
CAEEIATTNPVATEQYGCVAPGEGGHGQNEQAEEANND

SEQ ID NO: 201360 - protein, 39 aa, Artificial Sequence
  Description of Artificial Sequence: Synthetic polypeptide
DEGEIRTTNPVATEQYGAASCMCAGVDLLQEQVVQEDDN

SEQ ID NO: 201361 - protein, 35 aa, Artificial Sequence
  Description of Artificial Sequence: Synthetic polypeptide
DETEIRTTNPIATECWGATTWANAEDWYEPKGPYI

SEQ ID NO: 201362 - protein, 37 aa, Artificial Sequence
  Description of Artificial Sequence: Synthetic polypeptide
DENEISTTNPVATEQWGCVCSNWGEHNAEYSISDTAS

SEQ ID NO: 201363 - protein, 37 aa, Artificial Sequence
  Description of Artificial Sequence: Synthetic polypeptide
DEAEIRTTNGVAYCQYGCVCSNWGEHNAENFGSDTQS

SEQ ID NO: 201364 - protein, 36 aa, Artificial Sequence
  Description of Artificial Sequence: Synthetic polypeptide
DETEIACTNPVAYEQYGSACAANPAEGQDHQDDSAK

SEQ ID NO: 201365 - protein, 38 aa, Artificial Sequence
  Description of Artificial Sequence: Synthetic polypeptide
DENAIRATNPVATEQYWGTVTTTWLPWAEQENMQIDEI

SEQ ID NO: 201366 - protein, 34 aa, Artificial Sequence
  Description of Artificial Sequence: Synthetic polypeptide
NENAEIATTNPVAYEAWGSVYCGDFMDEKDGMDE

SEQ ID NO: 201367 - protein, 36 aa, Artificial Sequence
  Description of Artificial Sequence: Synthetic polypeptide
TTGTEIATTNPTAYECWGSVSGGPLNDDRQEQGNHG

SEQ ID NO: 201368 - protein, 35 aa, Artificial Sequence
  Description of Artificial Sequence: Synthetic polypeptide
DEGEIRTTNPIATECWGATTWANAEDTAEPKGPYI

SEQ ID NO: 201369 - protein, 35 aa, Artificial Sequence
  Description of Artificial Sequence: Synthetic polypeptide
DETEIRTTNPIATECWGATTWANAEDWWEPKGPYI

SEQ ID NO: 201370 - protein, 36 aa, Artificial Sequence
  Description of Artificial Sequence: Synthetic polypeptide
DETEIRTTNPIATECWGATTWANAEDWWAEPKGPRI

SEQ ID NO: 201371 - protein, 36 aa, Artificial Sequence
  Description of Artificial Sequence: Synthetic polypeptide
QAEEIATTNPVAYAPWGSFAGGTGNPQNGNPTEGAW

SEQ ID NO: 201372 - protein, 36 aa, Artificial Sequence
  Description of Artificial Sequence: Synthetic polypeptide
CAEEIATTNPVATEQWGCVAGPATGPAEAAIGDDPE

SEQ ID NO: 201373 - protein, 39 aa, Artificial Sequence
  Description of Artificial Sequence: Synthetic polypeptide
TEEEISTTNPVATEQYGQCVCSNWEEDHNAENFNSDTQA

SEQ ID NO: 201374 - protein, 37 aa, Artificial Sequence
  Description of Artificial Sequence: Synthetic polypeptide
QENEIATTNPVAYAPYGNTVSGENHLNQNHGMEMQLN

SEQ ID NO: 201375 - protein, 38 aa, Artificial Sequence
  Description of Artificial Sequence: Synthetic polypeptide
DEDEIACTNPVATEQWGHSFPSATWPAGTNQGNGMEPV

SEQ ID NO: 201376 - protein, 39 aa, Artificial Sequence
  Description of Artificial Sequence: Synthetic polypeptide
DEEEISTTNPVATEGYGQCVCSNWGEDHNEENFGSDTQS

SEQ ID NO: 201377 - protein, 38 aa, Artificial Sequence
  Description of Artificial Sequence: Synthetic polypeptide
TEEEISTTNPVAYECYGTVQACTGYNGDQNKTFGGQIE

SEQ ID NO: 201378 - protein, 35 aa, Artificial Sequence
  Description of Artificial Sequence: Synthetic polypeptide
DETEIRTTNPIATECWGATTWANAEDWPEHKGPYI

SEQ ID NO: 201379 - protein, 39 aa, Artificial Sequence
  Description of Artificial Sequence: Synthetic polypeptide
DEDEIACTNPVATEQWGHSFVSAMWPAGTNQGNPMEGVM

SEQ ID NO: 201380 - protein, 38 aa, Artificial Sequence
  Description of Artificial Sequence: Synthetic polypeptide
DEDEIACTNPVATEQWGHSMCSAMWPAGTNQGNGMEPV

SEQ ID NO: 201381 - protein, 35 aa, Artificial Sequence
  Description of Artificial Sequence: Synthetic polypeptide
DETEIRTTNPIATECWGATTWANAEDWNEPKGPYM

SEQ ID NO: 201382 - protein, 35 aa, Artificial Sequence
  Description of Artificial Sequence: Synthetic polypeptide
DETEIRTTNPIATECWGATTWANAEDWNEPKGPYI

SEQ ID NO: 201383 - protein, 38 aa, Artificial Sequence
  Description of Artificial Sequence: Synthetic polypeptide
DEEEISCTNPVATEEYGCVCSNSGEDHNAENFNSDNQA

SEQ ID NO: 201384 - protein, 38 aa, Artificial Sequence
  Description of Artificial Sequence: Synthetic polypeptide
DEEEISCTNPVATEGYGCVCSNWGEDDNDEYFNSDTQA

SEQ ID NO: 201385 - protein, 35 aa, Artificial Sequence
  Description of Artificial Sequence: Synthetic polypeptide
DETEIRTTNPIATECWGATTWANAEDWMEPKGPYI

SEQ ID NO: 201386 - protein, 38 aa, Artificial Sequence
  Description of Artificial Sequence: Synthetic polypeptide
QENEIVTTNPVATEQYGVVMAGPIEGEGGQTGEMNEDM

SEQ ID NO: 201387 - protein, 37 aa, Artificial Sequence
  Description of Artificial Sequence: Synthetic polypeptide
VEDEIATTNPVAYERWGSVSGGEYGNGGNMRNKMESM

SEQ ID NO: 201388 - protein, 37 aa, Artificial Sequence
  Description of Artificial Sequence: Synthetic polypeptide
TEEEISTTNPVAYECYGTVSACCGYEGQQNKFGGQIE

SEQ ID NO: 201389 - protein, 35 aa, Artificial Sequence
  Description of Artificial Sequence: Synthetic polypeptide
DETEIRTTNPIATECWGATTWANAEDWKEPNGPYI

SEQ ID NO: 201390 - protein, 35 aa, Artificial Sequence
  Description of Artificial Sequence: Synthetic polypeptide
DETEIRTTNPIATECWGATTWANAEDWKEPKGPYI

SEQ ID NO: 201391 - protein, 37 aa, Artificial Sequence
  Description of Artificial Sequence: Synthetic polypeptide
DENEISTTNPVATEQWGCVCGNSGEENAEYSISDTAS

SEQ ID NO: 201392 - protein, 38 aa, Artificial Sequence
  Description of Artificial Sequence: Synthetic polypeptide
TEECISTTNPVATEQYGQCVCSNWMEHNAEYFLSDTQS

SEQ ID NO: 201393 - protein, 38 aa, Artificial Sequence
  Description of Artificial Sequence: Synthetic polypeptide
DEEEISCTNPVATEGYGCVCSNWGEDHNAENFNSDNQS

SEQ ID NO: 201394 - protein, 38 aa, Artificial Sequence
  Description of Artificial Sequence: Synthetic polypeptide
DEEEISCTNPVATEGYGCVCSNWGEDHNAENFNSETQA

SEQ ID NO: 201395 - protein, 35 aa, Artificial Sequence
  Description of Artificial Sequence: Synthetic polypeptide
DETEIRTTNPIATECWGATTWANAEDWIEPKGPYI

SEQ ID NO: 201396 - protein, 38 aa, Artificial Sequence
  Description of Artificial Sequence: Synthetic polypeptide
DEEEISCTNPVATEGYGCVCSNWGEDHNQENFNSDTQS

SEQ ID NO: 201397 - protein, 37 aa, Artificial Sequence
  Description of Artificial Sequence: Synthetic polypeptide
TEECISTTNPVAYEQYGCVCSNWGEHNAEYFLSQTQA

SEQ ID NO: 201398 - protein, 35 aa, Artificial Sequence
  Description of Artificial Sequence: Synthetic polypeptide
DETEIRTTNPIATECWGATTWANAEDWHEPKGPYI

SEQ ID NO: 201399 - protein, 36 aa, Artificial Sequence
  Description of Artificial Sequence: Synthetic polypeptide
DETEIRTTNPIATECWGATTWANAEDWLAEPKGPYI

SEQ ID NO: 201400 - protein, 35 aa, Artificial Sequence
  Description of Artificial Sequence: Synthetic polypeptide
DEMEIRTTNPIATECWGATTWANAEDYAEPKGPYI

SEQ ID NO: 201401 - protein, 37 aa, Artificial Sequence
  Description of Artificial Sequence: Synthetic polypeptide
DEDEIATTNPVAYEQWGHCIIFAGNSGLVDNDGENAE

SEQ ID NO: 201402 - protein, 38 aa, Artificial Sequence
  Description of Artificial Sequence: Synthetic polypeptide
DENCIRTTNPVSTEQYGQCVCGNWGEDNAEGFNSQTQS

SEQ ID NO: 201403 - protein, 36 aa, Artificial Sequence
  Description of Artificial Sequence: Synthetic polypeptide
DEGEIRTTNPIATECWGATTWANAEDLWAEPKGPYI

SEQ ID NO: 201404 - protein, 39 aa, Artificial Sequence
  Description of Artificial Sequence: Synthetic polypeptide
DETEIACTNPVAYEQYGSTVCAVTEAGGAQASGGDNMAG

SEQ ID NO: 201405 - protein, 36 aa, Artificial Sequence
  Description of Artificial Sequence: Synthetic polypeptide
DETEIRTTNPIATECWGATTWANAEDWRAEPKGPYI

SEQ ID NO: 201406 - protein, 36 aa, Artificial Sequence
  Description of Artificial Sequence: Synthetic polypeptide
DETEIRTTNPIATECWGATTWANAEDWRAEPKGPTI

SEQ ID NO: 201407 - protein, 38 aa, Artificial Sequence
  Description of Artificial Sequence: Synthetic polypeptide
QEEEIATTNPVATEQYGVVMDGPGEGEGGQGGGEEDTA

SEQ ID NO: 201408 - protein, 37 aa, Artificial Sequence
  Description of Artificial Sequence: Synthetic polypeptide
CEAEISTTNPVATEGYGQCVCSSGEDHNQNFNSDTQS

SEQ ID NO: 201409 - protein, 35 aa, Artificial Sequence
  Description of Artificial Sequence: Synthetic polypeptide
AESEIACTNPVAYEGYGEATACELNLSQTTVGGDN

SEQ ID NO: 201410 - protein, 35 aa, Artificial Sequence
  Description of Artificial Sequence: Synthetic polypeptide
DETEIRTTNPIATECWGATTWANAEDWQEPKEPYI

SEQ ID NO: 201411 - protein, 35 aa, Artificial Sequence
  Description of Artificial Sequence: Synthetic polypeptide
QEEEIATTNPVAYEWYGEHAPWCYHEFSTHAEGEI

SEQ ID NO: 201412 - protein, 37 aa, Artificial Sequence
  Description of Artificial Sequence: Synthetic polypeptide
DEDEIACTNPVAYEQWGSVCSMANPALPEHMIDLTAM

SEQ ID NO: 201413 - protein, 37 aa, Artificial Sequence
  Description of Artificial Sequence: Synthetic polypeptide
DENEIACTNPVAYEQYGSACSVAPHLNNEAPMGEAIN

SEQ ID NO: 201414 - protein, 35 aa, Artificial Sequence
  Description of Artificial Sequence: Synthetic polypeptide
QEGEIAPTNPCSYEQYGVTVSCCEMISQSNGGTDR

SEQ ID NO: 201415 - protein, 36 aa, Artificial Sequence
  Description of Artificial Sequence: Synthetic polypeptide
DETEIRTTNPIATECWGATTWANAEDWQAEPKGPYI

SEQ ID NO: 201416 - protein, 35 aa, Artificial Sequence
  Description of Artificial Sequence: Synthetic polypeptide
DEMEIRTTNPIATECWGATTWANAEDWAEPKGPYI

SEQ ID NO: 201417 - protein, 35 aa, Artificial Sequence
  Description of Artificial Sequence: Synthetic polypeptide
DDSEVASTNPVSTEGYGLVSAANVTIMTSRVGQDL

SEQ ID NO: 201418 - protein, 38 aa, Artificial Sequence
  Description of Artificial Sequence: Synthetic polypeptide
QAEEIATTNPVATESYGSVCAPANHGGPLDSGEGTAMK

SEQ ID NO: 201419 - protein, 37 aa, Artificial Sequence
  Description of Artificial Sequence: Synthetic polypeptide
TEEEISTTNPVAYECYGTVQACSGYEGQQNKFGGQIL

SEQ ID NO: 201420 - protein, 34 aa, Artificial Sequence
  Description of Artificial Sequence: Synthetic polypeptide
DDSEVASTNPVSTEGYGAVVVAANNTIVSGVGQR

SEQ ID NO: 201421 - protein, 35 aa, Artificial Sequence
  Description of Artificial Sequence: Synthetic polypeptide
DETEIRTTNPIATECWGATTWANAEDWPEPKGPYI

SEQ ID NO: 201422 - protein, 37 aa, Artificial Sequence
  Description of Artificial Sequence: Synthetic polypeptide
TEEEISTTNPVAYECYGTVQACTGREGQDNKFGGQIE

SEQ ID NO: 201423 - protein, 35 aa, Artificial Sequence
  Description of Artificial Sequence: Synthetic polypeptide
DEREIRTTNPIATECWGATTWANAEDWAEPKGPYI

SEQ ID NO: 201424 - protein, 38 aa, Artificial Sequence
  Description of Artificial Sequence: Synthetic polypeptide
DESTICTTNPVATEQYGMSEDGDENMDPGNMDINGEEI

SEQ ID NO: 201425 - protein, 37 aa, Artificial Sequence
  Description of Artificial Sequence: Synthetic polypeptide
MEGEIRTTNPVATEQYGTCWWAGNEDEEQGESFELQI

SEQ ID NO: 201426 - protein, 35 aa, Artificial Sequence
  Description of Artificial Sequence: Synthetic polypeptide
DETEIRTTNPIATECWGATTWANAEDWSEPKGPYI

SEQ ID NO: 201427 - protein, 37 aa, Artificial Sequence
  Description of Artificial Sequence: Synthetic polypeptide
DETEIACTNPVAYEQWGHCNVAATANGLFAEAPMGVF

SEQ ID NO: 201428 - protein, 37 aa, Artificial Sequence
  Description of Artificial Sequence: Synthetic polypeptide
CDAEISTTNPVATEQYGCVCSWGEDHNIENFNSDTQA

SEQ ID NO: 201429 - protein, 35 aa, Artificial Sequence
  Description of Artificial Sequence: Synthetic polypeptide
DETEIRTTNPIATECWGATTWANAEEWAEPKGPSI

SEQ ID NO: 201430 - protein, 38 aa, Artificial Sequence
  Description of Artificial Sequence: Synthetic polypeptide
DEEEIATTNPVAYEQNYGCTIPNPNVGPLEASINEQTS

SEQ ID NO: 201431 - protein, 38 aa, Artificial Sequence
  Description of Artificial Sequence: Synthetic polypeptide
DEEEIATTNPVAYEQWGACYSGDFLQNDIQNTQGQDDT

SEQ ID NO: 201432 - protein, 35 aa, Artificial Sequence
  Description of Artificial Sequence: Synthetic polypeptide
DDSEVACTNPVSTEGYGNVCYNTDIQSRVHDQDRR

SEQ ID NO: 201433 - protein, 39 aa, Artificial Sequence
  Description of Artificial Sequence: Synthetic polypeptide
QEGEIATTNPVATEQYGNISGSAPDDTGREPHEKNEDTR

SEQ ID NO: 201434 - protein, 35 aa, Artificial Sequence
  Description of Artificial Sequence: Synthetic polypeptide
DETEIRTTNPIATECWGATTWANAENWAEPKGPYI

SEQ ID NO: 201435 - protein, 35 aa, Artificial Sequence
  Description of Artificial Sequence: Synthetic polypeptide
DETEIRTTNPIATECWGATTWANAEMWAEPKGPYI

SEQ ID NO: 201436 - protein, 36 aa, Artificial Sequence
  Description of Artificial Sequence: Synthetic polypeptide
DETEIRTTNPIATECWGATTWANAEMRWAEPKGPYI

SEQ ID NO: 201437 - protein, 36 aa, Artificial Sequence
  Description of Artificial Sequence: Synthetic polypeptide
QEEEIATTNPVAYEWYGQHAPNCEHEFSQSHNEGEW

SEQ ID NO: 201438 - protein, 39 aa, Artificial Sequence
  Description of Artificial Sequence: Synthetic polypeptide
QEGEIATTNPVATEQYGNLSFSEPDDTGREPHEKQEDTR

SEQ ID NO: 201439 - protein, 36 aa, Artificial Sequence
  Description of Artificial Sequence: Synthetic polypeptide
QEEEIATTNPVAYEWYGEVAPWCEHEFSHSMAEGEW

SEQ ID NO: 201440 - protein, 36 aa, Artificial Sequence
  Description of Artificial Sequence: Synthetic polypeptide
QAEEIATTNPVAYAPWGSVASGTGPPQNANPTEGAE

SEQ ID NO: 201441 - protein, 36 aa, Artificial Sequence
  Description of Artificial Sequence: Synthetic polypeptide
DETEIRTTNPIATECWGATTWANAELMWAEPKGPYI

SEQ ID NO: 201442 - protein, 38 aa, Artificial Sequence
  Description of Artificial Sequence: Synthetic polypeptide
CDAEISTTNPVATEQYGCVCSNWGEDHDQENFGSDNQS

SEQ ID NO: 201443 - protein, 37 aa, Artificial Sequence
  Description of Artificial Sequence: Synthetic polypeptide
DEDEIACTNPVATEQWGHNVSAMWPAGTNNGNPMEPV

SEQ ID NO: 201444 - protein, 38 aa, Artificial Sequence
  Description of Artificial Sequence: Synthetic polypeptide
DETEIACTNPVATEQYGSVCAMTGPHGIADAGIGEKDD

SEQ ID NO: 201445 - protein, 37 aa, Artificial Sequence
  Description of Artificial Sequence: Synthetic polypeptide
CDAEISTTNPVATEQYGCVCSNWGEHNAENFGSETQS

SEQ ID NO: 201446 - protein, 39 aa, Artificial Sequence
  Description of Artificial Sequence: Synthetic polypeptide
DEAEIRTTNPVATEQYGTFIYEGNENPDSSMVATENQNF

SEQ ID NO: 201447 - protein, 35 aa, Artificial Sequence
  Description of Artificial Sequence: Synthetic polypeptide
DETEIRTTNPIATECWGATTWANAEKWAEPKGPYI

SEQ ID NO: 201448 - protein, 37 aa, Artificial Sequence
  Description of Artificial Sequence: Synthetic polypeptide
CDAEISTTNPVATEQYGCVCSNWGEHNQEHFNSDNQM

SEQ ID NO: 201449 - protein, 35 aa, Artificial Sequence
  Description of Artificial Sequence: Synthetic polypeptide
DENEIATTNPCLYEEPYGTTSAMEWDQQQQNGNVH

SEQ ID NO: 201450 - protein, 35 aa, Artificial Sequence
  Description of Artificial Sequence: Synthetic polypeptide
DENEIATTNPVATASWGCVAGEGVEMNPALMDNHM

SEQ ID NO: 201451 - protein, 35 aa, Artificial Sequence
  Description of Artificial Sequence: Synthetic polypeptide
DETEIRTTNPIATECWGATTWANAEIWAEPKGPYI

SEQ ID NO: 201452 - protein, 35 aa, Artificial Sequence
  Description of Artificial Sequence: Synthetic polypeptide
DENEIATTNPVATASWGCNVAGEGEEMNAALDNFP

SEQ ID NO: 201453 - protein, 36 aa, Artificial Sequence
  Description of Artificial Sequence: Synthetic polypeptide
DETEIRTTNPIATECWGATTWANAENWPAERKGPYI

SEQ ID NO: 201454 - protein, 37 aa, Artificial Sequence
  Description of Artificial Sequence: Synthetic polypeptide
VEDEIACTNPVATEQWGCVAAIANALTAAAEGDDNED

SEQ ID NO: 201455 - protein, 35 aa, Artificial Sequence
  Description of Artificial Sequence: Synthetic polypeptide
DETEIRTTNPIATECWGATTWANAEPWAEPKGPYI

SEQ ID NO: 201456 - protein, 39 aa, Artificial Sequence
  Description of Artificial Sequence: Synthetic polypeptide
DEEEISTTNPVATEQWGQCVCSNWEEDHNAEGFNSDTQS

SEQ ID NO: 201457 - protein, 35 aa, Artificial Sequence
  Description of Artificial Sequence: Synthetic polypeptide
DEAAIRTTNPVASACWGSVSRCINNEPDVTDAEFL

SEQ ID NO: 201458 - protein, 35 aa, Artificial Sequence
  Description of Artificial Sequence: Synthetic polypeptide
DETEIRTTNPIATECWGATTWANAESWAEPKGPYW

SEQ ID NO: 201459 - protein, 35 aa, Artificial Sequence
  Description of Artificial Sequence: Synthetic polypeptide
DETEIRTTNPIATECWGATTWANAESWAEPKGPYI

SEQ ID NO: 201460 - protein, 36 aa, Artificial Sequence
  Description of Artificial Sequence: Synthetic polypeptide
DENEIATTNPVATAQWGCVAGEPGEIMNAALMDNVM

SEQ ID NO: 201461 - protein, 36 aa, Artificial Sequence
  Description of Artificial Sequence: Synthetic polypeptide
DEAAIRTTNPVASACWGSVSRCINNEPDVTDGEQLN

SEQ ID NO: 201462 - protein, 39 aa, Artificial Sequence
  Description of Artificial Sequence: Synthetic polypeptide
DEDEIACTNPVATEQWGGCVSAGKGGNHHQHNAAPGGNQ

SEQ ID NO: 201463 - protein, 38 aa, Artificial Sequence
  Description of Artificial Sequence: Synthetic polypeptide
CEAEISTTNPVATEEYGQCVCSTWGEDHNQNFNSDTQA

SEQ ID NO: 201464 - protein, 35 aa, Artificial Sequence
  Description of Artificial Sequence: Synthetic polypeptide
DETEIRTTNPIATECWGATTWANAESIAEPKGPYI

SEQ ID NO: 201465 - protein, 36 aa, Artificial Sequence
  Description of Artificial Sequence: Synthetic polypeptide
DEDEIACTNPVATEQWGHCSAAASNEFEHQDDIKAE

SEQ ID NO: 201466 - protein, 35 aa, Artificial Sequence
  Description of Artificial Sequence: Synthetic polypeptide
AESEIACTNPVGTEGYGVSCGSGEHNTHFGSDTQS

SEQ ID NO: 201467 - protein, 36 aa, Artificial Sequence
  Description of Artificial Sequence: Synthetic polypeptide
DETEIRTTNPIATECWGATTWANAERWAEPKGVPYI

SEQ ID NO: 201468 - protein, 37 aa, Artificial Sequence
  Description of Artificial Sequence: Synthetic polypeptide
DEEEIATTNPVAYEQMGCQIPNPNVLPCEASINEQTS

SEQ ID NO: 201469 - protein, 37 aa, Artificial Sequence
  Description of Artificial Sequence: Synthetic polypeptide
DEEEIATTNPVAYEQMGCTHPNPNVGPQEASINEQTS

SEQ ID NO: 201470 - protein, 36 aa, Artificial Sequence
  Description of Artificial Sequence: Synthetic polypeptide
DENEIATTNPVATAQWGGCCAGNFAGLEATANGEFD

SEQ ID NO: 201471 - protein, 37 aa, Artificial Sequence
  Description of Artificial Sequence: Synthetic polypeptide
DETEIACTNPVATEQYGSVCAAIEHPDAGAPLDEDAE

SEQ ID NO: 201472 - protein, 37 aa, Artificial Sequence
  Description of Artificial Sequence: Synthetic polypeptide
DENEIATTNPVATAQWGHSASAVGDLEADTPYGEDFH

SEQ ID NO: 201473 - protein, 37 aa, Artificial Sequence
  Description of Artificial Sequence: Synthetic polypeptide
DENEIATTNPVATAQWGHSASAVGDPEADTPWGEDNV

SEQ ID NO: 201474 - protein, 38 aa, Artificial Sequence
  Description of Artificial Sequence: Synthetic polypeptide
CEDEIATTNPVAYEQWGSVCSAANPPAPEAHGGDNEAP

SEQ ID NO: 201475 - protein, 38 aa, Artificial Sequence
  Description of Artificial Sequence: Synthetic polypeptide
DEDEIACTNPVAYEQWGSVICSPANPALQEHMIDITAK

SEQ ID NO: 201476 - protein, 37 aa, Artificial Sequence
  Description of Artificial Sequence: Synthetic polypeptide
VEDEIACTNPVATEQWGCVAAIANALTAPASGDDNEM

SEQ ID NO: 201477 - protein, 38 aa, Artificial Sequence
  Description of Artificial Sequence: Synthetic polypeptide
QAEEIATTNPVATEQWGCSVNANAGEPGEPLDNEGHSE

SEQ ID NO: 201478 - protein, 36 aa, Artificial Sequence
  Description of Artificial Sequence: Synthetic polypeptide
DETEIRTTNPIATECWGATTWANAEPWQAEPKGPYI

SEQ ID NO: 201479 - protein, 38 aa, Artificial Sequence
  Description of Artificial Sequence: Synthetic polypeptide
QEGEIATTNPVATEQYGNSSFSAPEDTLREPHEGEDAG

SEQ ID NO: 201480 - protein, 38 aa, Artificial Sequence
  Description of Artificial Sequence: Synthetic polypeptide
QEEEIRTTNPVATDQYGMITVGNMGMEDINEEGENEGD

SEQ ID NO: 201481 - protein, 33 aa, Artificial Sequence
  Description of Artificial Sequence: Synthetic polypeptide
AESEIASTNPVGTEAWGVCAPTDRDQHDGDDEI

SEQ ID NO: 201482 - protein, 35 aa, Artificial Sequence
  Description of Artificial Sequence: Synthetic polypeptide
DETEIRTTNPIATECWGATTWANAEIKAEPKGPYY

SEQ ID NO: 201483 - protein, 37 aa, Artificial Sequence
  Description of Artificial Sequence: Synthetic polypeptide
VEDEIATTNPVAYEQWGSVCAANNPAWIDRGDPMESW

SEQ ID NO: 201484 - protein, 35 aa, Artificial Sequence
  Description of Artificial Sequence: Synthetic polypeptide
DETEIRTTNPIATECWGATTWANAEGWAEPKGIYI

SEQ ID NO: 201485 - protein, 38 aa, Artificial Sequence
  Description of Artificial Sequence: Synthetic polypeptide
CDEEISTTNPVATEQYGCVCSNWGEWHNAENFNSDTQD

SEQ ID NO: 201486 - protein, 34 aa, Artificial Sequence
  Description of Artificial Sequence: Synthetic polypeptide
QENEIATTNPVAYEPWGPNVAGEGPQNHMGMQDN

SEQ ID NO: 201487 - protein, 39 aa, Artificial Sequence
  Description of Artificial Sequence: Synthetic polypeptide
TENIEEEISTTNPVAYEQWGSVCAWNEDLVHHERQDNEN

SEQ ID NO: 201488 - protein, 37 aa, Artificial Sequence
  Description of Artificial Sequence: Synthetic polypeptide
CEDEIATTNPVAYEQYGSCAGMGPAEGPNHQMGMQMN

SEQ ID NO: 201489 - protein, 35 aa, Artificial Sequence
  Description of Artificial Sequence: Synthetic polypeptide
NSAEIATTNPVAYEEWGSVTQQNMHSMNASGNEYQ

SEQ ID NO: 201490 - protein, 35 aa, Artificial Sequence
  Description of Artificial Sequence: Synthetic polypeptide
DETEIRTTNPIATECWGATTWANAEFWAEPKGPYI

SEQ ID NO: 201491 - protein, 39 aa, Artificial Sequence
  Description of Artificial Sequence: Synthetic polypeptide
TTTTCEEAICTVNPVATESYGSVSVVVTNIGIGNAGNDT

SEQ ID NO: 201492 - protein, 35 aa, Artificial Sequence
  Description of Artificial Sequence: Synthetic polypeptide
TTTETATTNPVAYEQWGSVAWVEIDTQDGQGDNIE

SEQ ID NO: 201493 - protein, 36 aa, Artificial Sequence
  Description of Artificial Sequence: Synthetic polypeptide
TTTETATTNPVAYEQWGSVAWTEIDTQNMGQGDNIK

SEQ ID NO: 201494 - protein, 36 aa, Artificial Sequence
  Description of Artificial Sequence: Synthetic polypeptide
NETEIATTNPVAYEPWGSSYPNDPQDQDIGRNDHKE

SEQ ID NO: 201495 - protein, 39 aa, Artificial Sequence
  Description of Artificial Sequence: Synthetic polypeptide
DEEEISTTNPVATEQWGQCQVCSYWGEAHNAEYFGSDQA

SEQ ID NO: 201496 - protein, 37 aa, Artificial Sequence
  Description of Artificial Sequence: Synthetic polypeptide
TENNEIATTNPVAYEPWGSVWTTNNDNQDGMGGGEDV

SEQ ID NO: 201497 - protein, 35 aa, Artificial Sequence
  Description of Artificial Sequence: Synthetic polypeptide
TTTETACTNPVAYEQWGSVAWTEIDTQDGQGDNIS

SEQ ID NO: 201498 - protein, 39 aa, Artificial Sequence
  Description of Artificial Sequence: Synthetic polypeptide
DEEEIACTNPVATEQYGTCSSAANTHGPEAGGNLMEHTN

SEQ ID NO: 201499 - protein, 37 aa, Artificial Sequence
  Description of Artificial Sequence: Synthetic polypeptide
DETEIACTNPVATESYGSACAAANPAEADAEIGNNTD

SEQ ID NO: 201500 - protein, 37 aa, Artificial Sequence
  Description of Artificial Sequence: Synthetic polypeptide
QAEEIATTNPVATEQYGCVAPGEGGHGPLASAEEANN

SEQ ID NO: 201501 - protein, 35 aa, Artificial Sequence
  Description of Artificial Sequence: Synthetic polypeptide
DDSEVASTNPVSYESYGCTVACNTEISQSRTGGQR

SEQ ID NO: 201502 - protein, 35 aa, Artificial Sequence
  Description of Artificial Sequence: Synthetic polypeptide
DEGEIRTTNPIATECWGATTWANAVDWAEPKGPYI

SEQ ID NO: 201503 - protein, 38 aa, Artificial Sequence
  Description of Artificial Sequence: Synthetic polypeptide
DDEEIGTTNPVAYEQYGQCVCSNWGEHNAENFNSDTQA

SEQ ID NO: 201504 - protein, 35 aa, Artificial Sequence
  Description of Artificial Sequence: Synthetic polypeptide
DEHEIATTNPIATECWGHTYYANENDQHEKTGKTM

SEQ ID NO: 201505 - protein, 35 aa, Artificial Sequence
  Description of Artificial Sequence: Synthetic polypeptide
DETEIRTTNPIATECWGATTWANAEEWAEPKGPYI

SEQ ID NO: 201506 - protein, 35 aa, Artificial Sequence
  Description of Artificial Sequence: Synthetic polypeptide
DEHEIACTNPVATASWGCTAGNNNLQEDAGGGKHH

SEQ ID NO: 201507 - protein, 37 aa, Artificial Sequence
  Description of Artificial Sequence: Synthetic polypeptide
TEEEISTTNPVAYENYGTVQACTGYEGQANKFGGQIM

SEQ ID NO: 201508 - protein, 35 aa, Artificial Sequence
  Description of Artificial Sequence: Synthetic polypeptide
DETEIRTTNPIATECWGATTWANAEGWAEPKGPYI

SEQ ID NO: 201509 - protein, 38 aa, Artificial Sequence
  Description of Artificial Sequence: Synthetic polypeptide
AEEAISTTNPVATEQYGQCVCSNWGEHNAEYFNSDNQP

SEQ ID NO: 201510 - protein, 39 aa, Artificial Sequence
  Description of Artificial Sequence: Synthetic polypeptide
QEGEIATTNPVATEQYGNYSFHASFDTLREPHEGLEDTR

SEQ ID NO: 201511 - protein, 38 aa, Artificial Sequence
  Description of Artificial Sequence: Synthetic polypeptide
AEEEIATTNPVAYEQWGVVCYQVTTNEHNQVDDTDRGE

SEQ ID NO: 201512 - protein, 34 aa, Artificial Sequence
  Description of Artificial Sequence: Synthetic polypeptide
AESEIASTNPVGTEAWGVCAPTDRDQHQGQEDIR

SEQ ID NO: 201513 - protein, 39 aa, Artificial Sequence
  Description of Artificial Sequence: Synthetic polypeptide
AEEAISTTNPVATEQYGQCVCSTWGEDDNAENFNSETQS

SEQ ID NO: 201514 - protein, 37 aa, Artificial Sequence
  Description of Artificial Sequence: Synthetic polypeptide
AEEEIATTNPVAYEQYGCSCQNWMEDNAEHFNSETQA

SEQ ID NO: 201515 - protein, 35 aa, Artificial Sequence
  Description of Artificial Sequence: Synthetic polypeptide
DETEIRTTNPIATECWGATTWANAEIEAEPKGPYI

SEQ ID NO: 201516 - protein, 39 aa, Artificial Sequence
  Description of Artificial Sequence: Synthetic polypeptide
MESEIRTTNPVATEQYGSTRNWMANVAETQTEVNIDNKM

SEQ ID NO: 201517 - protein, 38 aa, Artificial Sequence
  Description of Artificial Sequence: Synthetic polypeptide
AEEEIATTNPVAYEQYGCVCSNWGEDDNQEGFGSDTQA

SEQ ID NO: 201518 - protein, 39 aa, Artificial Sequence
  Description of Artificial Sequence: Synthetic polypeptide
DEEEIACTNPVATEQYGSTACAGANDGLPLGSGEGGEHQ

SEQ ID NO: 201519 - protein, 38 aa, Artificial Sequence
  Description of Artificial Sequence: Synthetic polypeptide
TEECIRTTNPVATEQYGQCVCNNWGEDNAEHFGSDTQS

SEQ ID NO: 201520 - protein, 37 aa, Artificial Sequence
  Description of Artificial Sequence: Synthetic polypeptide
DENAIRTTNPVATEQWGCVCSNSGPENAENFSSDTAS

SEQ ID NO: 201521 - protein, 36 aa, Artificial Sequence
  Description of Artificial Sequence: Synthetic polypeptide
AEEEIATTNPVAYEQYGCYCGWGEDNAEHFNSETQA

SEQ ID NO: 201522 - protein, 36 aa, Artificial Sequence
  Description of Artificial Sequence: Synthetic polypeptide
DENCIATVNPVATECYGVVVCIDHQQDQERQMIEDR

SEQ ID NO: 201523 - protein, 35 aa, Artificial Sequence
  Description of Artificial Sequence: Synthetic polypeptide
DETEIRTTNPIATECWGATTWANAEHWAEPKGPYI

SEQ ID NO: 201524 - protein, 37 aa, Artificial Sequence
  Description of Artificial Sequence: Synthetic polypeptide
DEAEIRTTNGVAYCQYGCVCSNWEDHNQENFGSDTQA

SEQ ID NO: 201525 - protein, 37 aa, Artificial Sequence
  Description of Artificial Sequence: Synthetic polypeptide
CAEEIATTNPVAYAQWGSVCSSANPAQQEHQDGTEMK

SEQ ID NO: 201526 - protein, 37 aa, Artificial Sequence
  Description of Artificial Sequence: Synthetic polypeptide
DEDEIATTNPVAYEQWGCPVAGEGPGNNHAGNPNGDP

SEQ ID NO: 201527 - protein, 38 aa, Artificial Sequence
  Description of Artificial Sequence: Synthetic polypeptide
TEECIRTTNPVATEQYGQCVCSNWGEDDNAEHFLSDQS

SEQ ID NO: 201528 - protein, 39 aa, Artificial Sequence
  Description of Artificial Sequence: Synthetic polypeptide
TEECIRTTNPVATEQYGQCVCSNWGEDHNAEYFLSDNQS

SEQ ID NO: 201529 - protein, 37 aa, Artificial Sequence
  Description of Artificial Sequence: Synthetic polypeptide
CEDEIATTNPVATEQYGSACAANPEPGQEHADDQDAH

SEQ ID NO: 201530 - protein, 38 aa, Artificial Sequence
  Description of Artificial Sequence: Synthetic polypeptide
QEQEIATTNPVATEQYGNISFSAPDDTLREPHEGEDTQ

SEQ ID NO: 201531 - protein, 34 aa, Artificial Sequence
  Description of Artificial Sequence: Synthetic polypeptide
VEDEIACTNPVATAQWGGCVAATAPGMMPGGTTK

SEQ ID NO: 201532 - protein, 35 aa, Artificial Sequence
  Description of Artificial Sequence: Synthetic polypeptide
DETEIRTTNPIATECWGATTWANAEGWAEWKGPYI

SEQ ID NO: 201533 - protein, 35 aa, Artificial Sequence
  Description of Artificial Sequence: Synthetic polypeptide
DETEIRTTNPIATECWGATTWANAEGWAEPKGQYI

SEQ ID NO: 201534 - protein, 39 aa, Artificial Sequence
  Description of Artificial Sequence: Synthetic polypeptide
DEEEISTTNPVATEGYGQCVCSNWGEDHNAEYFNSETQS

SEQ ID NO: 201535 - protein, 39 aa, Artificial Sequence
  Description of Artificial Sequence: Synthetic polypeptide
DEEEISTTNPVATEGYGQCVCSNWGEDHNAEGFNSDTQA

SEQ ID NO: 201536 - protein, 35 aa, Artificial Sequence
  Description of Artificial Sequence: Synthetic polypeptide
DETEIRTTNPIATECWGATTWANAEDWAEPDGPYI

SEQ ID NO: 201537 - protein, 38 aa, Artificial Sequence
  Description of Artificial Sequence: Synthetic polypeptide
DEMEIRTTNPVATCHYGCVCSNWGEDHNAENFTSDNQA

SEQ ID NO: 201538 - protein, 35 aa, Artificial Sequence
  Description of Artificial Sequence: Synthetic polypeptide
CEDEIACTNPVAYEQWGCVAANNGLTAAPDGDDSH

SEQ ID NO: 201539 - protein, 39 aa, Artificial Sequence
  Description of Artificial Sequence: Synthetic polypeptide
MEGEIATTNPVATEQYGNISFSAPFETLREPHEGLQDTR

SEQ ID NO: 201540 - protein, 37 aa, Artificial Sequence
  Description of Artificial Sequence: Synthetic polypeptide
DEDEIATTNPVATASWGHCVAAANNEPTDRGGENDGQ

SEQ ID NO: 201541 - protein, 37 aa, Artificial Sequence
  Description of Artificial Sequence: Synthetic polypeptide
DEAEIRTTNPVAYCGYGCVCSNWGEHNQEYFTSDNQA

SEQ ID NO: 201542 - protein, 37 aa, Artificial Sequence
  Description of Artificial Sequence: Synthetic polypeptide
DENEIATTNPVATEQWGHHVCAEGPHGENADITDGEH

SEQ ID NO: 201543 - protein, 37 aa, Artificial Sequence
  Description of Artificial Sequence: Synthetic polypeptide
CEDEIACTNPVATEQYGSCAAPGPHLPLDSGEGNDTN

SEQ ID NO: 201544 - protein, 38 aa, Artificial Sequence
  Description of Artificial Sequence: Synthetic polypeptide
DEQAEASSEISTNPVAYEQWGSVAKTEDVQRMNGDTAS

SEQ ID NO: 201545 - protein, 35 aa, Artificial Sequence
  Description of Artificial Sequence: Synthetic polypeptide
DETEIRTTNPIATECWGATTIANAEDWAEPKGPYQ

SEQ ID NO: 201546 - protein, 37 aa, Artificial Sequence
  Description of Artificial Sequence: Synthetic polypeptide
DENEESTGATTNPVAYESWGSVYCIENGGKEQGGQHQ

SEQ ID NO: 201547 - protein, 38 aa, Artificial Sequence
  Description of Artificial Sequence: Synthetic polypeptide
MEGEIATTNPVATMQYGSISFSAPDTLREPHEGMEDTR

SEQ ID NO: 201548 - protein, 35 aa, Artificial Sequence
  Description of Artificial Sequence: Synthetic polypeptide
DETEIRTTNPIATECWGATTIANAEDWAEPKGPYI

SEQ ID NO: 201549 - protein, 37 aa, Artificial Sequence
  Description of Artificial Sequence: Synthetic polypeptide
DEEEISTTNPCAYEGYGCSCSNWGEHNAENFGSDTQA

SEQ ID NO: 201550 - protein, 33 aa, Artificial Sequence
  Description of Artificial Sequence: Synthetic polypeptide
QAAEIATTNPVATASWGCNVAGAGDQTAGGDIF

SEQ ID NO: 201551 - protein, 39 aa, Artificial Sequence
  Description of Artificial Sequence: Synthetic polypeptide
CDEEIRTTNPVATEQYGQCVCSNWGEDHNAENFGSDTQS

SEQ ID NO: 201552 - protein, 35 aa, Artificial Sequence
  Description of Artificial Sequence: Synthetic polypeptide
DETEIRTTNPIATECWGATTHANAEDWAEPKGPYI

SEQ ID NO: 201553 - protein, 35 aa, Artificial Sequence
  Description of Artificial Sequence: Synthetic polypeptide
DETEIRTTNPIATECWGATTHANAEDWAEPKGAYI

SEQ ID NO: 201554 - protein, 38 aa, Artificial Sequence
  Description of Artificial Sequence: Synthetic polypeptide
CEAEISTTNPVAYEQYGCVCSTSGEDHNAENFNSDTQS

SEQ ID NO: 201555 - protein, 35 aa, Artificial Sequence
  Description of Artificial Sequence: Synthetic polypeptide
DETEIRTTNPIATECWGATTHANAEDWAEPFGPYI

SEQ ID NO: 201556 - protein, 39 aa, Artificial Sequence
  Description of Artificial Sequence: Synthetic polypeptide
CEEEIRTTNPVATEEYGQCVCSNWGEDHNAENFNSDNQA

SEQ ID NO: 201557 - protein, 37 aa, Artificial Sequence
  Description of Artificial Sequence: Synthetic polypeptide
DEEEIACTNPVAYEQWGHSPASLAGMGVQAEDPNENQ

SEQ ID NO: 201558 - protein, 38 aa, Artificial Sequence
  Description of Artificial Sequence: Synthetic polypeptide
DEEEIRATNPVATEQWGGCNPAINNHEEAAGMEMNAGE

SEQ ID NO: 201559 - protein, 38 aa, Artificial Sequence
  Description of Artificial Sequence: Synthetic polypeptide
CEAEISTTNPVAYEQYGCVCSTWGEDHNIENFNSDTQA

SEQ ID NO: 201560 - protein, 37 aa, Artificial Sequence
  Description of Artificial Sequence: Synthetic polypeptide
VEEEIACTNPVATEQWGCCFATNGQNPETLENGEEAP

SEQ ID NO: 201561 - protein, 35 aa, Artificial Sequence
  Description of Artificial Sequence: Synthetic polypeptide
DENTIATTNPVAYEQWGATYYSIEIEMNQREPDYH

SEQ ID NO: 201562 - protein, 38 aa, Artificial Sequence
  Description of Artificial Sequence: Synthetic polypeptide
DEMEICTTNPVATEQYGCACGCHATDGPTVEFEGGNDI

SEQ ID NO: 201563 - protein, 38 aa, Artificial Sequence
  Description of Artificial Sequence: Synthetic polypeptide
CEAEIACTNPVATEQYGSACAATNPAEEAGAHQDNDFP

SEQ ID NO: 201564 - protein, 35 aa, Artificial Sequence
  Description of Artificial Sequence: Synthetic polypeptide
DETEIATTNPVATAAWGCVAGEGEEANAALIDNAD

SEQ ID NO: 201565 - protein, 37 aa, Artificial Sequence
  Description of Artificial Sequence: Synthetic polypeptide
NEEEISTTNPVAYEQWGHNTVYYWEHQQHGRPTGAEI

SEQ ID NO: 201566 - protein, 35 aa, Artificial Sequence
  Description of Artificial Sequence: Synthetic polypeptide
DETEIRTTNPIATECWGATTNANAMDWAEPEGPYI

SEQ ID NO: 201567 - protein, 35 aa, Artificial Sequence
  Description of Artificial Sequence: Synthetic polypeptide
DETEIRTTNPIATECWGATTNANAEDWAEPKGPYI

SEQ ID NO: 201568 - protein, 35 aa, Artificial Sequence
  Description of Artificial Sequence: Synthetic polypeptide
DETEIRTTNPIATECWGATTMANAEDWTEPKGPYI

SEQ ID NO: 201569 - protein, 35 aa, Artificial Sequence
  Description of Artificial Sequence: Synthetic polypeptide
DETEIRTTNPIATECWGATTMANAEDWAEPLGPYI

SEQ ID NO: 201570 - protein, 38 aa, Artificial Sequence
  Description of Artificial Sequence: Synthetic polypeptide
DEEEIACTNPVATEQWGHVVANTGALADAGTHQIQEAW

SEQ ID NO: 201571 - protein, 37 aa, Artificial Sequence
  Description of Artificial Sequence: Synthetic polypeptide
CEDEIACTNPVATEQYGSCAAPGNHQPLDSGEGTDFN

SEQ ID NO: 201572 - protein, 35 aa, Artificial Sequence
  Description of Artificial Sequence: Synthetic polypeptide
DETEIRTTNPIATECWGATTMANAEDWAEPKGPYI

SEQ ID NO: 201573 - protein, 38 aa, Artificial Sequence
  Description of Artificial Sequence: Synthetic polypeptide
DETEIACTNPVATEQWGHCNVAATANGLPAEAPMGVYA

SEQ ID NO: 201574 - protein, 35 aa, Artificial Sequence
  Description of Artificial Sequence: Synthetic polypeptide
DETEIRTTNPIATECWGATTMANAEDWAEPKGPMI

SEQ ID NO: 201575 - protein, 35 aa, Artificial Sequence
  Description of Artificial Sequence: Synthetic polypeptide
DETEIRTTNPIATECWGATTLANAEDWTEPKGPYI

SEQ ID NO: 201576 - protein, 35 aa, Artificial Sequence
  Description of Artificial Sequence: Synthetic polypeptide
DETEIRTTNPIATECWGATTLANAEDWAEPKGPYP

SEQ ID NO: 201577 - protein, 36 aa, Artificial Sequence
  Description of Artificial Sequence: Synthetic polypeptide
DENEIATTNPVAYEQWGATYYSIEIREMNQREMDHF

SEQ ID NO: 201578 - protein, 35 aa, Artificial Sequence
  Description of Artificial Sequence: Synthetic polypeptide
QEEEIRTTNPIATECWGATAWPNEEDWQEPKEPYI

SEQ ID NO: 201579 - protein, 36 aa, Artificial Sequence
  Description of Artificial Sequence: Synthetic polypeptide
DEDEIACTNPVAYEQPYGVTPAANNGETGTQGGSEG

SEQ ID NO: 201580 - protein, 38 aa, Artificial Sequence
  Description of Artificial Sequence: Synthetic polypeptide
DEEEISTTNPEATCQYGCVCPNWGEDDNAEYFGSDNQA

SEQ ID NO: 201581 - protein, 35 aa, Artificial Sequence
  Description of Artificial Sequence: Synthetic polypeptide
DETEIRTTNPIATECWGATTLANAEDWAEPKGPYI

SEQ ID NO: 201582 - protein, 35 aa, Artificial Sequence
  Description of Artificial Sequence: Synthetic polypeptide
DETEIRTTNPIATECWGATTKANARDWAEPKGPYI

SEQ ID NO: 201583 - protein, 35 aa, Artificial Sequence
  Description of Artificial Sequence: Synthetic polypeptide
DEDEIATTNPVATASWGCVTAAAGNPDTMNPNGPH

SEQ ID NO: 201584 - protein, 35 aa, Artificial Sequence
  Description of Artificial Sequence: Synthetic polypeptide
DETEIRTTNPIATECWGATTKANAEDWAEPKGPYI

SEQ ID NO: 201585 - protein, 37 aa, Artificial Sequence
  Description of Artificial Sequence: Synthetic polypeptide
DEEEISTTNPCAYEQYGCVCGNWGEHNQENFISDTAS

SEQ ID NO: 201586 - protein, 35 aa, Artificial Sequence
  Description of Artificial Sequence: Synthetic polypeptide
DETEIRTTNPIATECWGATTKANAEDWAEPKGPYG

SEQ ID NO: 201587 - protein, 37 aa, Artificial Sequence
  Description of Artificial Sequence: Synthetic polypeptide
DEEEIATTNPVAYAPWGHSFACAAANGLPQSDEVDNS

SEQ ID NO: 201588 - protein, 36 aa, Artificial Sequence
  Description of Artificial Sequence: Synthetic polypeptide
CEDEIACTNPVAYEQWGCVAANNGQLQAAPDGAEEH

SEQ ID NO: 201589 - protein, 35 aa, Artificial Sequence
  Description of Artificial Sequence: Synthetic polypeptide
NENNEIATTNPVAYEAWGVVWPGPNNENDGQHGEE

SEQ ID NO: 201590 - protein, 35 aa, Artificial Sequence
  Description of Artificial Sequence: Synthetic polypeptide
DETEIRTTNPIATECWGATTGANAEDWASPKGPYI

SEQ ID NO: 201591 - protein, 39 aa, Artificial Sequence
  Description of Artificial Sequence: Synthetic polypeptide
DEDEIATTNPVATEQWGGCCVNAANVIENPQADMEGNNN

SEQ ID NO: 201592 - protein, 36 aa, Artificial Sequence
  Description of Artificial Sequence: Synthetic polypeptide
CEEEIACTNPVATEQYGSCAAAGPAEGADSGSGEDM

SEQ ID NO: 201593 - protein, 35 aa, Artificial Sequence
  Description of Artificial Sequence: Synthetic polypeptide
TNCEIATTNPVATEVWGTVCLQNDDQDGQHGDMHD

SEQ ID NO: 201594 - protein, 38 aa, Artificial Sequence
  Description of Artificial Sequence: Synthetic polypeptide
CEAAIRTTNPVATEQYGQCVCSNWGEHNAENFNSDNQQ

SEQ ID NO: 201595 - protein, 35 aa, Artificial Sequence
  Description of Artificial Sequence: Synthetic polypeptide
DENEIRTTNPVSYEPWGTISCMEDISQQQNGGDHD

SEQ ID NO: 201596 - protein, 35 aa, Artificial Sequence
  Description of Artificial Sequence: Synthetic polypeptide
DETEIRTTNPIATECWGATTCANAEDWAEPEGGYV

SEQ ID NO: 201597 - protein, 35 aa, Artificial Sequence
  Description of Artificial Sequence: Synthetic polypeptide
DETEIRTTNPIATECWGATTCANAEDAAEPKGPYI

SEQ ID NO: 201598 - protein, 35 aa, Artificial Sequence
  Description of Artificial Sequence: Synthetic polypeptide
TEFPIASTNPVAYEAWGITVVPTGHPHQTRGDNNP

SEQ ID NO: 201599 - protein, 35 aa, Artificial Sequence
  Description of Artificial Sequence: Synthetic polypeptide
DETEIRTTNPIATECWGATTCANAEAWAEPKGPYI

SEQ ID NO: 201600 - protein, 37 aa, Artificial Sequence
  Description of Artificial Sequence: Synthetic polypeptide
AEECISTTNPVATEGYGCVCSNWGEHNAENFNSETQS

SEQ ID NO: 201601 - protein, 34 aa, Artificial Sequence
  Description of Artificial Sequence: Synthetic polypeptide
YETEIASTNPIATECWGAVWANAENLAESKGPYI

SEQ ID NO: 201602 - protein, 35 aa, Artificial Sequence
  Description of Artificial Sequence: Synthetic polypeptide
DETEIATTNPVATAQWGGCCAGQGNGPEATANGEF

SEQ ID NO: 201603 - protein, 37 aa, Artificial Sequence
  Description of Artificial Sequence: Synthetic polypeptide
DETEIATTNPVATAQWGHSAFAVGDGEADTPGGEDNH

SEQ ID NO: 201604 - protein, 37 aa, Artificial Sequence
  Description of Artificial Sequence: Synthetic polypeptide
DETEIATTNPVATAQWGHSAFAVGPLEADTPSGEDNH

SEQ ID NO: 201605 - protein, 35 aa, Artificial Sequence
  Description of Artificial Sequence: Synthetic polypeptide
DENEIRTTNPVSYEPWGTISCMEDISQQQNGGSDH

SEQ ID NO: 201606 - protein, 40 aa, Artificial Sequence
  Description of Artificial Sequence: Synthetic polypeptide
DEEEIRTTNPVATEAYGVVATTQIGTTEQGSTNDEDNSET

SEQ ID NO: 201607 - protein, 35 aa, Artificial Sequence
  Description of Artificial Sequence: Synthetic polypeptide
NENSEIATTNPVAYEAWGVVWPGPNNENDMQNGEE

SEQ ID NO: 201608 - protein, 34 aa, Artificial Sequence
  Description of Artificial Sequence: Synthetic polypeptide
QENEIATTNPVAYAPWGNTVAGEGHLQNHMGMFK

SEQ ID NO: 201609 - protein, 39 aa, Artificial Sequence
  Description of Artificial Sequence: Synthetic polypeptide
TMEIEMEIIVTATNPIATNLQYQGSVGDINIQIRITNDE

SEQ ID NO: 201610 - protein, 39 aa, Artificial Sequence
  Description of Artificial Sequence: Synthetic polypeptide
CEEEIRTTNPVATEGYGQCVCSNWGEDHNAEYFNSENQS

SEQ ID NO: 201611 - protein, 39 aa, Artificial Sequence
  Description of Artificial Sequence: Synthetic polypeptide
TIRMEECICTTNNATNCATEQYGSVTVTVNQLNENDGNV

SEQ ID NO: 201612 - protein, 38 aa, Artificial Sequence
  Description of Artificial Sequence: Synthetic polypeptide
DEEEIACTNPVATEQYGSACAAINPPEEAGAEQDEDAP

SEQ ID NO: 201613 - protein, 37 aa, Artificial Sequence
  Description of Artificial Sequence: Synthetic polypeptide
DEGEIATTNPVAYEPQWGHSACAAANGDAMQAGDQHQ

SEQ ID NO: 201614 - protein, 35 aa, Artificial Sequence
  Description of Artificial Sequence: Synthetic polypeptide
DETEIRTTNPIATECWGATTCANAEDWAEPKGPYI

SEQ ID NO: 201615 - protein, 38 aa, Artificial Sequence
  Description of Artificial Sequence: Synthetic polypeptide
AEEEIATTNPVATAQWGGCFVANANGLPTEAPGENMFA

SEQ ID NO: 201616 - protein, 39 aa, Artificial Sequence
  Description of Artificial Sequence: Synthetic polypeptide
TNEEEIAELATTNPVATTQWGCVCDSGHGQRGTQRGEAS

SEQ ID NO: 201617 - protein, 35 aa, Artificial Sequence
  Description of Artificial Sequence: Synthetic polypeptide
DETEIRTTNPIATECWGATTCANAEDWAEPKGWYI

SEQ ID NO: 201618 - protein, 35 aa, Artificial Sequence
  Description of Artificial Sequence: Synthetic polypeptide
DETEIRTTNPIATECWGATTGANAEDWAEPKGPYI

SEQ ID NO: 201619 - protein, 37 aa, Artificial Sequence
  Description of Artificial Sequence: Synthetic polypeptide
CEEEIATTNPVAYTYAQWGSVCAAGADGNPDNLEGAE

SEQ ID NO: 201620 - protein, 36 aa, Artificial Sequence
  Description of Artificial Sequence: Synthetic polypeptide
AEEEIATTNPTAYEPWGSVCSNIEQDQDDQQQNGHG

SEQ ID NO: 201621 - protein, 35 aa, Artificial Sequence
  Description of Artificial Sequence: Synthetic polypeptide
DETEIRTTNPIATECWGATTFANAEDWAEPKGPYI

SEQ ID NO: 201622 - protein, 35 aa, Artificial Sequence
  Description of Artificial Sequence: Synthetic polypeptide
DETEIATTNPVATAAWGGCCAGVGNGLEATANGEF

SEQ ID NO: 201623 - protein, 35 aa, Artificial Sequence
  Description of Artificial Sequence: Synthetic polypeptide
DEDEIATTNPVATASWGCIITAAAINPDTMNPEPH

SEQ ID NO: 201624 - protein, 35 aa, Artificial Sequence
  Description of Artificial Sequence: Synthetic polypeptide
QEEEIRTTNPIATECWGATTWANEEDWQEPKEPYI

SEQ ID NO: 201625 - protein, 35 aa, Artificial Sequence
  Description of Artificial Sequence: Synthetic polypeptide
DETEIRTTNPIATECWGATTFANAEDMAEPKGPYI

SEQ ID NO: 201626 - protein, 35 aa, Artificial Sequence
  Description of Artificial Sequence: Synthetic polypeptide
DETEIRTTNPIATECWGATTDANAEGWAEPKGPYI

SEQ ID NO: 201627 - protein, 38 aa, Artificial Sequence
  Description of Artificial Sequence: Synthetic polypeptide
DEEEIRTTNPVATEQYGSIHRWCYIPEDIEAYEYQFKT

SEQ ID NO: 201628 - protein, 35 aa, Artificial Sequence
  Description of Artificial Sequence: Synthetic polypeptide
DETEIRTTNPIATECWGATTDANAEDWAEPKGPYI

SEQ ID NO: 201629 - protein, 35 aa, Artificial Sequence
  Description of Artificial Sequence: Synthetic polypeptide
DETEIRTTNPIATECWGATTDANAEDWAEHTGPYI

SEQ ID NO: 201630 - protein, 34 aa, Artificial Sequence
  Description of Artificial Sequence: Synthetic polypeptide
TEFEIASVNPVCYEPYGVTVNTINQSTAAGGNNV

SEQ ID NO: 201631 - protein, 35 aa, Artificial Sequence
  Description of Artificial Sequence: Synthetic polypeptide
DETEIRTTNPIATECWGATTCSAAEDWAEPKGPYI

SEQ ID NO: 201632 - protein, 35 aa, Artificial Sequence
  Description of Artificial Sequence: Synthetic polypeptide
DETEIRTTNPIATECWGATTCENAEDWAEPMGQYI

SEQ ID NO: 201633 - protein, 37 aa, Artificial Sequence
  Description of Artificial Sequence: Synthetic polypeptide
DETEIATTNPVATAQWGANITTSAMNHLAGMPGGSEH

SEQ ID NO: 201634 - protein, 38 aa, Artificial Sequence
  Description of Artificial Sequence: Synthetic polypeptide
TEGNAEIATTNPVAYEQWGSVCTIEDNEMTRTDDGTHN

SEQ ID NO: 201635 - protein, 35 aa, Artificial Sequence
  Description of Artificial Sequence: Synthetic polypeptide
DETEIRTTNPIATECWGATTCANTEDWAEPKGPYI

SEQ ID NO: 201636 - protein, 35 aa, Artificial Sequence
  Description of Artificial Sequence: Synthetic polypeptide
DETEIRTTNPIATECWGATTCANAVDIAEPHGPYI

SEQ ID NO: 201637 - protein, 38 aa, Artificial Sequence
  Description of Artificial Sequence: Synthetic polypeptide
DETEIATTNPVATAQWGCNVIAAMNNLTNPDNQMEGRP

SEQ ID NO: 201638 - protein, 35 aa, Artificial Sequence
  Description of Artificial Sequence: Synthetic polypeptide
DETEIRTTNPIATECWGATTCANAEDWAEPQGPII

SEQ ID NO: 201639 - protein, 35 aa, Artificial Sequence
  Description of Artificial Sequence: Synthetic polypeptide
QENEIATTNPVAYEPYGNTTSGEHLNQNHMEMQLN

SEQ ID NO: 201640 - protein, 37 aa, Artificial Sequence
  Description of Artificial Sequence: Synthetic polypeptide
AEECIATTNPVATEGYGCSCPNSGEDNAEHFNSENQS

SEQ ID NO: 201641 - protein, 36 aa, Artificial Sequence
  Description of Artificial Sequence: Synthetic polypeptide
DEEEIATTNPVAYAPWGHSACAAANGDAMQGGDQHH

SEQ ID NO: 201642 - protein, 38 aa, Artificial Sequence
  Description of Artificial Sequence: Synthetic polypeptide
QENEIATTNPVATEQWGCIITAGKGGNHHQHNAAAGNV

SEQ ID NO: 201643 - protein, 38 aa, Artificial Sequence
  Description of Artificial Sequence: Synthetic polypeptide
DETEIACTNPVATEQWGHSASAAGPTPGANGALMGAQH

SEQ ID NO: 201644 - protein, 37 aa, Artificial Sequence
  Description of Artificial Sequence: Synthetic polypeptide
DENCIATVNPVATECYGSVVCIDHQQDQERQQNIEPN

SEQ ID NO: 201645 - protein, 36 aa, Artificial Sequence
  Description of Artificial Sequence: Synthetic polypeptide
DESEIRTTNPVSTECWGCIAPEDGQQQQQQRGGVKS

SEQ ID NO: 201646 - protein, 35 aa, Artificial Sequence
  Description of Artificial Sequence: Synthetic polypeptide
DEHEIATTNPVAYECWGTVYRINENFDRQMKTDGI

SEQ ID NO: 201647 - protein, 38 aa, Artificial Sequence
  Description of Artificial Sequence: Synthetic polypeptide
CEEEIACTNPVATEQYGSACSAPMPHLEAEAPIEEAGN

SEQ ID NO: 201648 - protein, 38 aa, Artificial Sequence
  Description of Artificial Sequence: Synthetic polypeptide
DEEEISTTNPCATEGYGCSCSNWGEDHNAEYFGSDTQS

SEQ ID NO: 201649 - protein, 35 aa, Artificial Sequence
  Description of Artificial Sequence: Synthetic polypeptide
DDSEVASTNPVSYEGYGNTVACNTEISQVRTGGSR

SEQ ID NO: 201650 - protein, 38 aa, Artificial Sequence
  Description of Artificial Sequence: Synthetic polypeptide
NDEEIRTTNPVATEQYGQCVCSNWGEHNAENFISDTQS

SEQ ID NO: 201651 - protein, 38 aa, Artificial Sequence
  Description of Artificial Sequence: Synthetic polypeptide
DETEIRTTNPCATEAYGVVATTNNNANDETGTEEGSVI

SEQ ID NO: 201652 - protein, 38 aa, Artificial Sequence
  Description of Artificial Sequence: Synthetic polypeptide
DDEEIRTTNPVATCGYGCVCSNWGEGDNQENFNSDTQA

SEQ ID NO: 201653 - protein, 39 aa, Artificial Sequence
  Description of Artificial Sequence: Synthetic polypeptide
DDEEIRTTNPVATCGYGQCVCSNWGEGDNAENFGSDNQS

SEQ ID NO: 201654 - protein, 35 aa, Artificial Sequence
  Description of Artificial Sequence: Synthetic polypeptide
DEHEIATTNPVAYECWGTCYWINENQDRQMIHLGS

SEQ ID NO: 201655 - protein, 37 aa, Artificial Sequence
  Description of Artificial Sequence: Synthetic polypeptide
DETEIACTNPVATEQWGSVAIEPPGGDNGAGNPIGQN

SEQ ID NO: 201656 - protein, 35 aa, Artificial Sequence
  Description of Artificial Sequence: Synthetic polypeptide
DETEIRTTNPIATECWGATTPANAEHSAEPKGPYI

SEQ ID NO: 201657 - protein, 34 aa, Artificial Sequence
  Description of Artificial Sequence: Synthetic polypeptide
DESEVRTTNPIATEGWGATTWANNETWAEPVGPI

SEQ ID NO: 201658 - protein, 38 aa, Artificial Sequence
  Description of Artificial Sequence: Synthetic polypeptide
DEEEIACTNPVATEQWGHVVANTGALADAGTHQIQDSV

SEQ ID NO: 201659 - protein, 35 aa, Artificial Sequence
  Description of Artificial Sequence: Synthetic polypeptide
DEMEIRTTNPIATECWGATTCANAEDWAEPKGPYI

SEQ ID NO: 201660 - protein, 37 aa, Artificial Sequence
  Description of Artificial Sequence: Synthetic polypeptide
DETEIACTNPVATEQWGSVAAMPGPQGNPEPGDQQVH

SEQ ID NO: 201661 - protein, 38 aa, Artificial Sequence
  Description of Artificial Sequence: Synthetic polypeptide
DEEEISTTNPEATEQYGCVCPNWMEDHNAEYFISDTQS

SEQ ID NO: 201662 - protein, 38 aa, Artificial Sequence
  Description of Artificial Sequence: Synthetic polypeptide
DEMEIRTTNPVATEGWGQCVCSNWGEENIEYFNSDTQA

SEQ ID NO: 201663 - protein, 37 aa, Artificial Sequence
  Description of Artificial Sequence: Synthetic polypeptide
DETEIACTNPVATEQWGSACAAANPGVNAAGGDNNDD

SEQ ID NO: 201664 - protein, 39 aa, Artificial Sequence
  Description of Artificial Sequence: Synthetic polypeptide
CEEEIGTTNPVATEQYGQCQVCSNWGEHNAENFNSDTQP

SEQ ID NO: 201665 - protein, 36 aa, Artificial Sequence
  Description of Artificial Sequence: Synthetic polypeptide
TQDEIRTTNPVSYEAWGSTVFMQALSQTHSGTNEDT

SEQ ID NO: 201666 - protein, 36 aa, Artificial Sequence
  Description of Artificial Sequence: Synthetic polypeptide
DENDEIATTNPVAYEAWGVVWPGPNNENDGQQNGDS

SEQ ID NO: 201667 - protein, 35 aa, Artificial Sequence
  Description of Artificial Sequence: Synthetic polypeptide
DETEIRTTNPIATECWGATTPANAEDWAEPPGPYQ

SEQ ID NO: 201668 - protein, 37 aa, Artificial Sequence
  Description of Artificial Sequence: Synthetic polypeptide
DEEEISTTNPCATEEYGQCVCQWMEHNAENFGSDTAA

SEQ ID NO: 201669 - protein, 35 aa, Artificial Sequence
  Description of Artificial Sequence: Synthetic polypeptide
DETEIRTTNPIATECWGATTPANAEDWAEPKGPYI

SEQ ID NO: 201670 - protein, 34 aa, Artificial Sequence
  Description of Artificial Sequence: Synthetic polypeptide
DESEVRTTNPIATEGWGNTTWANNETWASPVGPI

SEQ ID NO: 201671 - protein, 38 aa, Artificial Sequence
  Description of Artificial Sequence: Synthetic polypeptide
DEGELATTNPVAYEQWGSVSGGEPGNGGNMRRVMEMMA

SEQ ID NO: 201672 - protein, 34 aa, Artificial Sequence
  Description of Artificial Sequence: Synthetic polypeptide
AEDENSTTNPVAYESWGCVYYGDQPDHQQRNGAE

SEQ ID NO: 201673 - protein, 34 aa, Artificial Sequence
  Description of Artificial Sequence: Synthetic polypeptide
QENEIATTNPVAYAPWGNTVAGEGHLQNHMMNMK

SEQ ID NO: 201674 - protein, 36 aa, Artificial Sequence
  Description of Artificial Sequence: Synthetic polypeptide
NEEEIATTNPVAYEQYGEHAPPCEHEFSQHAEGEWQ

SEQ ID NO: 201675 - protein, 38 aa, Artificial Sequence
  Description of Artificial Sequence: Synthetic polypeptide
CEREISTTNPVATEQYGCVCSNWGEDHNQENFGSETQS

SEQ ID NO: 201676 - protein, 35 aa, Artificial Sequence
  Description of Artificial Sequence: Synthetic polypeptide
DETEIRTTNPIATECWGATTQANAEDWAEPKGPYI

SEQ ID NO: 201677 - protein, 37 aa, Artificial Sequence
  Description of Artificial Sequence: Synthetic polypeptide
DEEEIACTNPVATAQWGHSACAAGPLDNTANPGNMTV

SEQ ID NO: 201678 - protein, 37 aa, Artificial Sequence
  Description of Artificial Sequence: Synthetic polypeptide
DETEIACTNPVATEQWGSVCAAGDPIGNNHADDMNDS

SEQ ID NO: 201679 - protein, 36 aa, Artificial Sequence
  Description of Artificial Sequence: Synthetic polypeptide
NTNEIATTNPVAYEQWGCVYNNVVRPEDVQAGENAS

SEQ ID NO: 201680 - protein, 35 aa, Artificial Sequence
  Description of Artificial Sequence: Synthetic polypeptide
DETEIRTTNPIATECWGATTQANAEDWAEPFGPYI

SEQ ID NO: 201681 - protein, 34 aa, Artificial Sequence
  Description of Artificial Sequence: Synthetic polypeptide
DESEVRTTNPISTECWGATWANNETIAEPKGPYR

SEQ ID NO: 201682 - protein, 35 aa, Artificial Sequence
  Description of Artificial Sequence: Synthetic polypeptide
DEHEIATTNPVAYECWGTVYWINEDVDRQMIHVGS

SEQ ID NO: 201683 - protein, 38 aa, Artificial Sequence
  Description of Artificial Sequence: Synthetic polypeptide
NENEIRTTNPVATEQYGMVSVEGMGDGGQGQEQDEAGV

SEQ ID NO: 201684 - protein, 33 aa, Artificial Sequence
  Description of Artificial Sequence: Synthetic polypeptide
DDSEVASTNPVSTEGYGMVAAYTIQESKVGQMW

SEQ ID NO: 201685 - protein, 37 aa, Artificial Sequence
  Description of Artificial Sequence: Synthetic polypeptide
DEDEIACTNPVATEQYGSCAAAGGAHGINNADPNADD

SEQ ID NO: 201686 - protein, 35 aa, Artificial Sequence
  Description of Artificial Sequence: Synthetic polypeptide
VESEIRTTNPVSTEPWGCIAPEDGQQQQDQRGTAS

SEQ ID NO: 201687 - protein, 37 aa, Artificial Sequence
  Description of Artificial Sequence: Synthetic polypeptide
DENEIATTNPVSTEGYGCICSNWEEHNAEYFGSDNQA

SEQ ID NO: 201688 - protein, 35 aa, Artificial Sequence
  Description of Artificial Sequence: Synthetic polypeptide
VESEIRTTNPVSTEAWGCIAPEDGQQQQQQRGTES

SEQ ID NO: 201689 - protein, 34 aa, Artificial Sequence
  Description of Artificial Sequence: Synthetic polypeptide
DDSEVASTNPVSTEGYGCVCFNSEDNQEYFGSQQ

SEQ ID NO: 201690 - protein, 37 aa, Artificial Sequence
  Description of Artificial Sequence: Synthetic polypeptide
DEGVEIATTNPVAYEKWGEVAWGEQEQGNHGNGGNGR

SEQ ID NO: 201691 - protein, 37 aa, Artificial Sequence
  Description of Artificial Sequence: Synthetic polypeptide
CEDEIACTNPVATEQYGSCAAPGNHLPLDSPEGSDEN

SEQ ID NO: 201692 - protein, 38 aa, Artificial Sequence
  Description of Artificial Sequence: Synthetic polypeptide
DEMEIATTNPVAYEQYGQCVCSNWGEPNAENFGSDTQA

SEQ ID NO: 201693 - protein, 38 aa, Artificial Sequence
  Description of Artificial Sequence: Synthetic polypeptide
DETEIRTTNPCATEAYGVVATTNANNNDTGTEEGTIYI

SEQ ID NO: 201694 - protein, 35 aa, Artificial Sequence
  Description of Artificial Sequence: Synthetic polypeptide
DETEIRTTNPIATECWGATTPANAIDWASPKGPYH

SEQ ID NO: 201695 - protein, 40 aa, Artificial Sequence
  Description of Artificial Sequence: Synthetic polypeptide
NEQEIRTTNPVATEQYGECQWTSRAVSALNPNIDESTQYR

SEQ ID NO: 201696 - protein, 35 aa, Artificial Sequence
  Description of Artificial Sequence: Synthetic polypeptide
DETEIRTTNPIATECWGATTPACAEDQAEPTGPYQ

SEQ ID NO: 201697 - protein, 38 aa, Artificial Sequence
  Description of Artificial Sequence: Synthetic polypeptide
DENNEIATTNPVAYEQWGEVCSTPNQGNHGEAGGDGHN

SEQ ID NO: 201698 - protein, 35 aa, Artificial Sequence
  Description of Artificial Sequence: Synthetic polypeptide
DEMEIRTTNPIATECWGATTCSAAEDWAEPKGPYI

SEQ ID NO: 201699 - protein, 38 aa, Artificial Sequence
  Description of Artificial Sequence: Synthetic polypeptide
DEEEISTTNPVATEGYGCVCSNWMEDHNQENFMSDTQS

SEQ ID NO: 201700 - protein, 38 aa, Artificial Sequence
  Description of Artificial Sequence: Synthetic polypeptide
CDEEIRTTNPVATEQYGCVCSNWGEDHDIEHFNSDTQT

SEQ ID NO: 201701 - protein, 35 aa, Artificial Sequence
  Description of Artificial Sequence: Synthetic polypeptide
DETEIRTTNPCATECWGATTWANAEDWAEPKGPYI

SEQ ID NO: 201702 - protein, 39 aa, Artificial Sequence
  Description of Artificial Sequence: Synthetic polypeptide
QEPEICTTNPVATEIYGSVVLNNDGENVLQNIEGQGTGT

SEQ ID NO: 201703 - protein, 37 aa, Artificial Sequence
  Description of Artificial Sequence: Synthetic polypeptide
DEEEISTTNPEATCQYGCVCPNWGEHNAEYFNSDTQS

SEQ ID NO: 201704 - protein, 34 aa, Artificial Sequence
  Description of Artificial Sequence: Synthetic polypeptide
DENQIATTNPTAYEQWGATYYNIEIEMNQRMMDH

SEQ ID NO: 201705 - protein, 38 aa, Artificial Sequence
  Description of Artificial Sequence: Synthetic polypeptide
DETEIACTNPVATEQWGHSQASYAGPQPGANGALMGQD

SEQ ID NO: 201706 - protein, 39 aa, Artificial Sequence
  Description of Artificial Sequence: Synthetic polypeptide
DENEIATTNPVAYEPQPWGQSSAQGNDLVQTAGGITMRH

SEQ ID NO: 201707 - protein, 38 aa, Artificial Sequence
  Description of Artificial Sequence: Synthetic polypeptide
DETEIACTNPVATEQWGHSQASAGPAPGANGALMGAND

SEQ ID NO: 201708 - protein, 36 aa, Artificial Sequence
  Description of Artificial Sequence: Synthetic polypeptide
DEDEIACTNPVAYEQWGCVAGTNPGEAEAPPDDLNN

SEQ ID NO: 201709 - protein, 37 aa, Artificial Sequence
  Description of Artificial Sequence: Synthetic polypeptide
DEAAECEIAATNPVAYEPWGVCAMWINDQLSDGNGQR

SEQ ID NO: 201710 - protein, 37 aa, Artificial Sequence
  Description of Artificial Sequence: Synthetic polypeptide
DETEIACTNPVATEQWGHSPAAAGPPGANGALMGNQD

SEQ ID NO: 201711 - protein, 38 aa, Artificial Sequence
  Description of Artificial Sequence: Synthetic polypeptide
DEAEIRTTNGVAYCQYGCVCSTWGEDHNIENFGSDTQA

SEQ ID NO: 201712 - protein, 34 aa, Artificial Sequence
  Description of Artificial Sequence: Synthetic polypeptide
DETEIATTNPIGTECWGATTWANAEDLAHKGPYI

SEQ ID NO: 201713 - protein, 34 aa, Artificial Sequence
  Description of Artificial Sequence: Synthetic polypeptide
DETEIATTNPIGTECWGATTWANAEDLAPKGPYI

SEQ ID NO: 201714 - protein, 36 aa, Artificial Sequence
  Description of Artificial Sequence: Synthetic polypeptide
DETEIRTTNPIATECWGATTPACAEDSTEPPVGPYI

SEQ ID NO: 201715 - protein, 35 aa, Artificial Sequence
  Description of Artificial Sequence: Synthetic polypeptide
DEAEIRTTNPVAYACMGSNSQEVDIEVSYEELMEG

SEQ ID NO: 201716 - protein, 38 aa, Artificial Sequence
  Description of Artificial Sequence: Synthetic polypeptide
DETEIACTNPVATEQWGHSASYAGPQPGGNGALMGNQD

SEQ ID NO: 201717 - protein, 38 aa, Artificial Sequence
  Description of Artificial Sequence: Synthetic polypeptide
DETEIACTNPVATEQWGHSASGAGPQPGANGALMGEQM

SEQ ID NO: 201718 - protein, 37 aa, Artificial Sequence
  Description of Artificial Sequence: Synthetic polypeptide
DETEIACTNPVATEQWGHSASAGPHPGANGALMGAQI

SEQ ID NO: 201719 - protein, 33 aa, Artificial Sequence
  Description of Artificial Sequence: Synthetic polypeptide
DEEEIATTNPIATECWGATWAAEDWAEPKEEYI

SEQ ID NO: 201720 - protein, 37 aa, Artificial Sequence
  Description of Artificial Sequence: Synthetic polypeptide
DETEIACTNPVATEQWGHSASAGPAPGANGAPMGAQD

SEQ ID NO: 201721 - protein, 38 aa, Artificial Sequence
  Description of Artificial Sequence: Synthetic polypeptide
DEMEIRTTNPVATEGYGQCICSNWGETNIENFISDTQS

SEQ ID NO: 201722 - protein, 37 aa, Artificial Sequence
  Description of Artificial Sequence: Synthetic polypeptide
DENEISTTNPVATEGWGCVTSNWGAHNAEYFNSDNAA

SEQ ID NO: 201723 - protein, 38 aa, Artificial Sequence
  Description of Artificial Sequence: Synthetic polypeptide
DEMEIRTTNPVATEGWGQCVCSWGEDHNAEYFGSDTQS

SEQ ID NO: 201724 - protein, 37 aa, Artificial Sequence
  Description of Artificial Sequence: Synthetic polypeptide
VEDEIATTNPVAYEPQWGCVAINPALGTMHQMDNEQD

SEQ ID NO: 201725 - protein, 35 aa, Artificial Sequence
  Description of Artificial Sequence: Synthetic polypeptide
DETEIRTTNPCATECWGATTWANAEDWAEPKGPYE

SEQ ID NO: 201726 - protein, 36 aa, Artificial Sequence
  Description of Artificial Sequence: Synthetic polypeptide
DESEIRTTNPVSTEHWGCIAPEDGQQQQQQRTGTKT

SEQ ID NO: 201727 - protein, 37 aa, Artificial Sequence
  Description of Artificial Sequence: Synthetic polypeptide
VEDEIATTNPVAYEQYGSACSPAGEGGVGMPGDQTNH

SEQ ID NO: 201728 - protein, 36 aa, Artificial Sequence
  Description of Artificial Sequence: Synthetic polypeptide
DENEIATTNPVAYEQWGATYYSIEIREMNQREPDGH

SEQ ID NO: 201729 - protein, 39 aa, Artificial Sequence
  Description of Artificial Sequence: Synthetic polypeptide
MEEEISTTNPVATEQYGQCVCSNWGEDHNAEHFNSENQA

SEQ ID NO: 201730 - protein, 36 aa, Artificial Sequence
  Description of Artificial Sequence: Synthetic polypeptide
DETEIACTNPVATEQWGNCAAGDAEGQDHQDGDNHW

SEQ ID NO: 201731 - protein, 36 aa, Artificial Sequence
  Description of Artificial Sequence: Synthetic polypeptide
DESEIRTTNPVSTEPWGCIAPEDGQQQHQQREGTKS

SEQ ID NO: 201732 - protein, 36 aa, Artificial Sequence
  Description of Artificial Sequence: Synthetic polypeptide
AEDEIRTTNPVAYEQYGQKTAPAPFAPSQNPVNNQY

SEQ ID NO: 201733 - protein, 36 aa, Artificial Sequence
  Description of Artificial Sequence: Synthetic polypeptide
AEEEIACTNPVATEQYGCYCPWEEDNQEHFNSETQA

SEQ ID NO: 201734 - protein, 36 aa, Artificial Sequence
  Description of Artificial Sequence: Synthetic polypeptide
DEDEIATTNPVATASWGCVAAANHDSTAQAEQNEHS

SEQ ID NO: 201735 - protein, 38 aa, Artificial Sequence
  Description of Artificial Sequence: Synthetic polypeptide
NEEATDSEIATTNPVAYEQWGVVVPTDNHQIQERVDGV

SEQ ID NO: 201736 - protein, 37 aa, Artificial Sequence
  Description of Artificial Sequence: Synthetic polypeptide
DENDEIATTNPVAYEAWGVVWPGPNNENDQGQGNGEE

SEQ ID NO: 201737 - protein, 35 aa, Artificial Sequence
  Description of Artificial Sequence: Synthetic polypeptide
DETEIRTTNPCATECWGACTWFNAEDWSEPQGPQI

SEQ ID NO: 201738 - protein, 38 aa, Artificial Sequence
  Description of Artificial Sequence: Synthetic polypeptide
DEAAIRTTNPVATEQYGCTCSNWGEDHNAENFGSDTQS

SEQ ID NO: 201739 - protein, 36 aa, Artificial Sequence
  Description of Artificial Sequence: Synthetic polypeptide
QEGEIAPTNPCSYEQYGKTVACCNMLSQNSLGGTDR

SEQ ID NO: 201740 - protein, 35 aa, Artificial Sequence
  Description of Artificial Sequence: Synthetic polypeptide
DETEIRTTNPCATECWGATAWANAEDWAEPKGPYI

SEQ ID NO: 201741 - protein, 35 aa, Artificial Sequence
  Description of Artificial Sequence: Synthetic polypeptide
DESEIRTTNPVSTEPWGCIAPEDGQQQQQQNGTAS

SEQ ID NO: 201742 - protein, 36 aa, Artificial Sequence
  Description of Artificial Sequence: Synthetic polypeptide
DETEIRTTNPCATECWGATTQANVSDWAEIVGEPDI

SEQ ID NO: 201743 - protein, 36 aa, Artificial Sequence
  Description of Artificial Sequence: Synthetic polypeptide
DEDEIATTNPVATASWGCVAAANGEVNDAGGENANG

SEQ ID NO: 201744 - protein, 33 aa, Artificial Sequence
  Description of Artificial Sequence: Synthetic polypeptide
DENEIAATNPCIYEPYGTTSAMEWDQQQQNGDH

SEQ ID NO: 201745 - protein, 36 aa, Artificial Sequence
  Description of Artificial Sequence: Synthetic polypeptide
CEDEIATTNPVAYEQWGSCAAGPALGPNHQMGMQME

SEQ ID NO: 201746 - protein, 35 aa, Artificial Sequence
  Description of Artificial Sequence: Synthetic polypeptide
DETEIRTTNPCATECWGATTWANAEDWAELKGPYI

SEQ ID NO: 201747 - protein, 38 aa, Artificial Sequence
  Description of Artificial Sequence: Synthetic polypeptide
CEEEIACTNPVATEQYGSACAGQNPDEEAGAHQDGDAP

SEQ ID NO: 201748 - protein, 37 aa, Artificial Sequence
  Description of Artificial Sequence: Synthetic polypeptide
DEEEIACTNPVAYEQWGCNVVAAIQAPLITAGDPMNN

SEQ ID NO: 201749 - protein, 36 aa, Artificial Sequence
  Description of Artificial Sequence: Synthetic polypeptide
TNPEISTTNPVAYEQWGVCVNEVNGDKQTGQGGDDR

SEQ ID NO: 201750 - protein, 39 aa, Artificial Sequence
  Description of Artificial Sequence: Synthetic polypeptide
DEEEIACTNPVATEQWGHVVNANTGALADAGTHQDNEEW

SEQ ID NO: 201751 - protein, 37 aa, Artificial Sequence
  Description of Artificial Sequence: Synthetic polypeptide
TGTEIATTNPVAYEQWGSCVQNGGNAGEDLRREGDAP

SEQ ID NO: 201752 - protein, 37 aa, Artificial Sequence
  Description of Artificial Sequence: Synthetic polypeptide
MENEIRTTNPVATEQYGCVAMDQDMEQQLVSTIEEHL

SEQ ID NO: 201753 - protein, 35 aa, Artificial Sequence
  Description of Artificial Sequence: Synthetic polypeptide
DETEIRTTNPIATECWGATAWANEEDWAEPKGPYI

SEQ ID NO: 201754 - protein, 37 aa, Artificial Sequence
  Description of Artificial Sequence: Synthetic polypeptide
DEDEIATTNPVAYEQWGTSVCAATAHGAAAPPGSWQN

SEQ ID NO: 201755 - protein, 34 aa, Artificial Sequence
  Description of Artificial Sequence: Synthetic polypeptide
DDSEVASTNPVSTEGYGCVCATWEIQEGFGSQQG

SEQ ID NO: 201756 - protein, 38 aa, Artificial Sequence
  Description of Artificial Sequence: Synthetic polypeptide
DEGEIATTNPVAYEQWGHCVFAANTGGLEAIANPDDRH

SEQ ID NO: 201757 - protein, 38 aa, Artificial Sequence
  Description of Artificial Sequence: Synthetic polypeptide
DEEEISTTNPCATEQYGQCVCPNWGEDNAENFGSDTQA

SEQ ID NO: 201758 - protein, 37 aa, Artificial Sequence
  Description of Artificial Sequence: Synthetic polypeptide
QEGEIATTNPVATAQWGHVVANTGNGEYGAEGDGNTA

SEQ ID NO: 201759 - protein, 38 aa, Artificial Sequence
  Description of Artificial Sequence: Synthetic polypeptide
DEEEISTTNPCATEQYGQCVCPNWGEHNQEYFISDTQA

SEQ ID NO: 201760 - protein, 37 aa, Artificial Sequence
  Description of Artificial Sequence: Synthetic polypeptide
DEGEIATTNPVAYEQWGPCVFAGNNGLQTQAQDQMAE

SEQ ID NO: 201761 - protein, 38 aa, Artificial Sequence
  Description of Artificial Sequence: Synthetic polypeptide
DEDEIRTTNPVATDFYGAVVDGVGGIGDQALTNGNGDD

SEQ ID NO: 201762 - protein, 39 aa, Artificial Sequence
  Description of Artificial Sequence: Synthetic polypeptide
MEGEIRTTNPVATEQYGACWCSETYNENPMEIEEGMAEV

SEQ ID NO: 201763 - protein, 34 aa, Artificial Sequence
  Description of Artificial Sequence: Synthetic polypeptide
DDSEVASTNPVSTEGYGCVCANWPIQESFGSQQM

SEQ ID NO: 201764 - protein, 37 aa, Artificial Sequence
  Description of Artificial Sequence: Synthetic polypeptide
DEEEIATTNPVAYEQWGHSTACAAANPLAADPIEDHQ

SEQ ID NO: 201765 - protein, 35 aa, Artificial Sequence
  Description of Artificial Sequence: Synthetic polypeptide
DETEIRTTNPIATECWGATAWANAEDWEEPQIPII

SEQ ID NO: 201766 - protein, 37 aa, Artificial Sequence
  Description of Artificial Sequence: Synthetic polypeptide
DEEEIATTNPVAYEQWGHSACAAANPLEAIAPIEDHQ

SEQ ID NO: 201767 - protein, 37 aa, Artificial Sequence
  Description of Artificial Sequence: Synthetic polypeptide
DEDEIATTNPVAYEQWGTTACAATAGELPDSGSNGVY

SEQ ID NO: 201768 - protein, 37 aa, Artificial Sequence
  Description of Artificial Sequence: Synthetic polypeptide
DETEIATTNPVATEQWGGCTAGNNALPTANDDSENQD

SEQ ID NO: 201769 - protein, 37 aa, Artificial Sequence
  Description of Artificial Sequence: Synthetic polypeptide
VEDEIATTNPVATEQYGSACAANPENGGEHQDDQDAH

SEQ ID NO: 201770 - protein, 37 aa, Artificial Sequence
  Description of Artificial Sequence: Synthetic polypeptide
NEREIRTTNPVAYEQYGCVCQWGEDHNQENFGSDTQS

SEQ ID NO: 201771 - protein, 35 aa, Artificial Sequence
  Description of Artificial Sequence: Synthetic polypeptide
DETEIRTTNPIATECWGATAWANAEDWAEPKGPYI

SEQ ID NO: 201772 - protein, 38 aa, Artificial Sequence
  Description of Artificial Sequence: Synthetic polypeptide
VEDEIATTNPVATEQYGSACAIANPELGQEHQDDQFAH

SEQ ID NO: 201773 - protein, 36 aa, Artificial Sequence
  Description of Artificial Sequence: Synthetic polypeptide
DETEIRTTNPIATECWGAATTWANAEDWAEPKGPYA

SEQ ID NO: 201774 - protein, 36 aa, Artificial Sequence
  Description of Artificial Sequence: Synthetic polypeptide
DETEIRTTNPIATECWGAATTWANAEDWAEPKGPYI

SEQ ID NO: 201775 - protein, 38 aa, Artificial Sequence
  Description of Artificial Sequence: Synthetic polypeptide
VEDEIATTNPVATEQYGSTACAANPELGQEHADDQDAH

SEQ ID NO: 201776 - protein, 40 aa, Artificial Sequence
  Description of Artificial Sequence: Synthetic polypeptide
DENEIRVTNPVATEQYGQASCMCVAGVDLLQEMVVQEDRN

SEQ ID NO: 201777 - protein, 36 aa, Artificial Sequence
  Description of Artificial Sequence: Synthetic polypeptide
NATEIATTNPVAYEQWGSARCTENKDQDHLHGKDMH

SEQ ID NO: 201778 - protein, 37 aa, Artificial Sequence
  Description of Artificial Sequence: Synthetic polypeptide
DEDEIATTNPVAYEQWGTNCAATAGELPDSQGPNDTV

SEQ ID NO: 201779 - protein, 35 aa, Artificial Sequence
  Description of Artificial Sequence: Synthetic polypeptide
DENEIAPTNPVAYEQWGATYYSIEIEMNQREMDAY

SEQ ID NO: 201780 - protein, 35 aa, Artificial Sequence
  Description of Artificial Sequence: Synthetic polypeptide
DETEIRTTNPIATECWGATGWANAEDNAEPKGPYI

SEQ ID NO: 201781 - protein, 33 aa, Artificial Sequence
  Description of Artificial Sequence: Synthetic polypeptide
DDSEVASTNPVSTEGWGNVWAAADIAERVGQYR

SEQ ID NO: 201782 - protein, 37 aa, Artificial Sequence
  Description of Artificial Sequence: Synthetic polypeptide
MENEIRTTNPVATEQWGIVVDNEEGEEMNVGEGDGAQ

SEQ ID NO: 201783 - protein, 35 aa, Artificial Sequence
  Description of Artificial Sequence: Synthetic polypeptide
DETEIRTTNPIATEAWGATTWANAEDWAEPKGPYI

SEQ ID NO: 201784 - protein, 35 aa, Artificial Sequence
  Description of Artificial Sequence: Synthetic polypeptide
DETEIRTTNPIATECWGATGCANAGDWPEPKGPYY

SEQ ID NO: 201785 - protein, 35 aa, Artificial Sequence
  Description of Artificial Sequence: Synthetic polypeptide
DETEIRTTNPIATECWGATFWANDEDWAEPKGPYI

SEQ ID NO: 201786 - protein, 35 aa, Artificial Sequence
  Description of Artificial Sequence: Synthetic polypeptide
DETEIRTTNPIATECWGATFWANAEDWAEPKGPYI

SEQ ID NO: 201787 - protein, 34 aa, Artificial Sequence
  Description of Artificial Sequence: Synthetic polypeptide
TEVSIAATNPVAYDPWGIVPSCTQAEHSQRGEHQ

SEQ ID NO: 201788 - protein, 36 aa, Artificial Sequence
  Description of Artificial Sequence: Synthetic polypeptide
CEDEIACTNPVATEQWGCVAGNGVGPAEATAQGGDD

SEQ ID NO: 201789 - protein, 35 aa, Artificial Sequence
  Description of Artificial Sequence: Synthetic polypeptide
DETEIRTTNPIATEAWGATTWVNAEDWAEPKGPYI

SEQ ID NO: 201790 - protein, 35 aa, Artificial Sequence
  Description of Artificial Sequence: Synthetic polypeptide
DETEIRTTNPIATECWGATFCANAEDWAEPKGPYI

SEQ ID NO: 201791 - protein, 35 aa, Artificial Sequence
  Description of Artificial Sequence: Synthetic polypeptide
DETEIRTTNPIATEAWGCQTCGNAEDHAEGSGETI

SEQ ID NO: 201792 - protein, 39 aa, Artificial Sequence
  Description of Artificial Sequence: Synthetic polypeptide
DEMEIRTTNPVATEGYGQCVCFNWGEDHNTENFISDNQS

SEQ ID NO: 201793 - protein, 39 aa, Artificial Sequence
  Description of Artificial Sequence: Synthetic polypeptide
DEMEIRTTNPVATEGYGQCVTSTWGADHNAEHFISDTQS

SEQ ID NO: 201794 - protein, 37 aa, Artificial Sequence
  Description of Artificial Sequence: Synthetic polypeptide
VEDEIATTNPVATEQYGNACAANPELGQEHQDDQTAH

SEQ ID NO: 201795 - protein, 38 aa, Artificial Sequence
  Description of Artificial Sequence: Synthetic polypeptide
MENEIRTTNPVATEQWGGVVDNNEEGEEMNQGEGDGII

SEQ ID NO: 201796 - protein, 35 aa, Artificial Sequence
  Description of Artificial Sequence: Synthetic polypeptide
DETEIRTTNPIATECWGATCWANAEDWAEPKGPYI

SEQ ID NO: 201797 - protein, 37 aa, Artificial Sequence
  Description of Artificial Sequence: Synthetic polypeptide
DETEIACTNPVATAQWGSVSVSGNPEENTGGVIEASM

SEQ ID NO: 201798 - protein, 37 aa, Artificial Sequence
  Description of Artificial Sequence: Synthetic polypeptide
DEGEIATTNPVAYEQWGHCIFAANTGGLEAIANPDRV

SEQ ID NO: 201799 - protein, 38 aa, Artificial Sequence
  Description of Artificial Sequence: Synthetic polypeptide
DEDEIRTTNPVATDFYGAVVDGVGGIGDQALDIGNGDI

SEQ ID NO: 201800 - protein, 39 aa, Artificial Sequence
  Description of Artificial Sequence: Synthetic polypeptide
DEEEISTTNPCATEQYGQCVCGNWGEDHNQENFGSDTAS

SEQ ID NO: 201801 - protein, 37 aa, Artificial Sequence
  Description of Artificial Sequence: Synthetic polypeptide
NEQEIRTTNPVATEFYGVVVQIGANMDDGGLDDSDTM

SEQ ID NO: 201802 - protein, 38 aa, Artificial Sequence
  Description of Artificial Sequence: Synthetic polypeptide
DAEEIATTNPVATEQYGSVCAMANHADDSKAPDDSAEN

SEQ ID NO: 201803 - protein, 36 aa, Artificial Sequence
  Description of Artificial Sequence: Synthetic polypeptide
DETEIACTNPVATASWGCVAGNNNLTQEDAGGGKHE

SEQ ID NO: 201804 - protein, 38 aa, Artificial Sequence
  Description of Artificial Sequence: Synthetic polypeptide
DEQEIATTNPVATEQYGCTACAMNPVGDNAAMTPGSQD

SEQ ID NO: 201805 - protein, 39 aa, Artificial Sequence
  Description of Artificial Sequence: Synthetic polypeptide
DEMEICTTNPVATEQYGCACVCHATDGPTVESFEGPNDI

SEQ ID NO: 201806 - protein, 34 aa, Artificial Sequence
  Description of Artificial Sequence: Synthetic polypeptide
DDSEVASTNPVSTEGYGCVCADWEINQERFGSQQ

SEQ ID NO: 201807 - protein, 35 aa, Artificial Sequence
  Description of Artificial Sequence: Synthetic polypeptide
DETEIRTTNPIATECWGAITWANAYDWAEPKGPYI

SEQ ID NO: 201808 - protein, 36 aa, Artificial Sequence
  Description of Artificial Sequence: Synthetic polypeptide
DETEIRTTNPIATECWGAATWANAEDWAEPKGNPYI

SEQ ID NO: 201809 - protein, 35 aa, Artificial Sequence
  Description of Artificial Sequence: Synthetic polypeptide
DETEIRTTNPIATECWGAATWANAEDWAEPKGPYI

SEQ ID NO: 201810 - protein, 35 aa, Artificial Sequence
  Description of Artificial Sequence: Synthetic polypeptide
DETEIRTTNPIATECWGAITWANAEDWAEPKGPYI

SEQ ID NO: 201811 - protein, 34 aa, Artificial Sequence
  Description of Artificial Sequence: Synthetic polypeptide
TESPICPTNPVAYEAWGQTVVPTGHPHQIGDNNP

SEQ ID NO: 201812 - protein, 35 aa, Artificial Sequence
  Description of Artificial Sequence: Synthetic polypeptide
DETEIRTTNPIATECWGAITWANAEDWAEPKGPWI

SEQ ID NO: 201813 - protein, 35 aa, Artificial Sequence
  Description of Artificial Sequence: Synthetic polypeptide
DETEIRTTNPIATECWGAITWANAECWAEPKGPYI

SEQ ID NO: 201814 - protein, 37 aa, Artificial Sequence
  Description of Artificial Sequence: Synthetic polypeptide
NEREISTTNPVATEQYGCVCQWGEDHNQEYFGSDTQS

SEQ ID NO: 201815 - protein, 35 aa, Artificial Sequence
  Description of Artificial Sequence: Synthetic polypeptide
DETEIRTTNPIATECWGAHTWANAEDWAEPKGPYI

SEQ ID NO: 201816 - protein, 35 aa, Artificial Sequence
  Description of Artificial Sequence: Synthetic polypeptide
DETEIRTTNPIATECWGAHTWANAEDWAEPKGHYI

SEQ ID NO: 201817 - protein, 35 aa, Artificial Sequence
  Description of Artificial Sequence: Synthetic polypeptide
DETEIRTTNPIATECWGAGTWANAFDWEEGQGPQI

SEQ ID NO: 201818 - protein, 37 aa, Artificial Sequence
  Description of Artificial Sequence: Synthetic polypeptide
DEMEICTTNPVATEQYGCACGCHATFGPTVEFEGQDI

SEQ ID NO: 201819 - protein, 35 aa, Artificial Sequence
  Description of Artificial Sequence: Synthetic polypeptide
TESPICSTNPVAYEAWGQTVVPQTHPHQTRGDNNP

SEQ ID NO: 201820 - protein, 34 aa, Artificial Sequence
  Description of Artificial Sequence: Synthetic polypeptide
TESPICSTNPVAYEAWGQQVVPTHPHQTAGDNNP

SEQ ID NO: 201821 - protein, 34 aa, Artificial Sequence
  Description of Artificial Sequence: Synthetic polypeptide
TESPICSTNPVAYEAWGITVVPTHPHQPNGDNNP

SEQ ID NO: 201822 - protein, 38 aa, Artificial Sequence
  Description of Artificial Sequence: Synthetic polypeptide
AEEEIATTNPVATEQYGCSCGNWGELDNAEHFISENQA

SEQ ID NO: 201823 - protein, 35 aa, Artificial Sequence
  Description of Artificial Sequence: Synthetic polypeptide
DETEIRTTNPIATECWGAGTWANADDWAEPQGPQI

SEQ ID NO: 201824 - protein, 35 aa, Artificial Sequence
  Description of Artificial Sequence: Synthetic polypeptide
DETEIRTTNPIATECWGAFTWANAEDWAEPSGPYI

SEQ ID NO: 201825 - protein, 35 aa, Artificial Sequence
  Description of Artificial Sequence: Synthetic polypeptide
DETEIRTTNPIATECWGAFTWANAEDWAEPKGRYI

SEQ ID NO: 201826 - protein, 35 aa, Artificial Sequence
  Description of Artificial Sequence: Synthetic polypeptide
DETEIRTTNPIATECWGAFTWANAEDWAEPKGPYI

SEQ ID NO: 201827 - protein, 35 aa, Artificial Sequence
  Description of Artificial Sequence: Synthetic polypeptide
DETEIRTTNPIATECWGACTWANIEDWAEPKGPYI

SEQ ID NO: 201828 - protein, 35 aa, Artificial Sequence
  Description of Artificial Sequence: Synthetic polypeptide
DETEIRTTNPIATECWGACTWANAEDWAIPKGPYI

SEQ ID NO: 201829 - protein, 35 aa, Artificial Sequence
  Description of Artificial Sequence: Synthetic polypeptide
DETEIRTTNPIATECWGACTWANAEDWAEPKGPYI

SEQ ID NO: 201830 - protein, 38 aa, Artificial Sequence
  Description of Artificial Sequence: Synthetic polypeptide
CDEEISTTNPVATEQYGQCVCSNSEEPNTEGFGSDTQA

SEQ ID NO: 201831 - protein, 36 aa, Artificial Sequence
  Description of Artificial Sequence: Synthetic polypeptide
TESEIRTTNPVSYEAWGSTVFMLQALSQTHSGTIDT

SEQ ID NO: 201832 - protein, 35 aa, Artificial Sequence
  Description of Artificial Sequence: Synthetic polypeptide
DETEIRTTNPIATECWGALTWANAEDWAEPHGPYI

SEQ ID NO: 201833 - protein, 35 aa, Artificial Sequence
  Description of Artificial Sequence: Synthetic polypeptide
DETEIRTTNPIATECWGALTWANAEDWAEPKNPYI

SEQ ID NO: 201834 - protein, 38 aa, Artificial Sequence
  Description of Artificial Sequence: Synthetic polypeptide
CDEEISTTNPVATEQYGQCVCSNWGEHNIEHFNSDTQM

SEQ ID NO: 201835 - protein, 35 aa, Artificial Sequence
  Description of Artificial Sequence: Synthetic polypeptide
DEGVACCTNPVATEQWGCCAPPALTQNHQGDGEAP

SEQ ID NO: 201836 - protein, 35 aa, Artificial Sequence
  Description of Artificial Sequence: Synthetic polypeptide
DETEIRTTNPIATECWGAATWANAADWAEPKGPYI

SEQ ID NO: 201837 - protein, 37 aa, Artificial Sequence
  Description of Artificial Sequence: Synthetic polypeptide
NEREISTTNPVAYEQYGCVCQNWGEHNQENFGSDTQS

SEQ ID NO: 201838 - protein, 38 aa, Artificial Sequence
  Description of Artificial Sequence: Synthetic polypeptide
MENEIRTTNPVATEQWGAVVDNGEEGQEMGAGEGVGEQ

SEQ ID NO: 201839 - protein, 34 aa, Artificial Sequence
  Description of Artificial Sequence: Synthetic polypeptide
DETEIRTTNPIATECWGATANAEDEADPKGEPYG

SEQ ID NO: 201840 - protein, 37 aa, Artificial Sequence
  Description of Artificial Sequence: Synthetic polypeptide
DEMEICTTNPVATEQYGCACNCHATDGPTVEFEFNDI

SEQ ID NO: 201841 - protein, 37 aa, Artificial Sequence
  Description of Artificial Sequence: Synthetic polypeptide
QAEEIATTNPVATEQYGSACAANNGPEADMPMGAMQH

SEQ ID NO: 201842 - protein, 36 aa, Artificial Sequence
  Description of Artificial Sequence: Synthetic polypeptide
VEEEIACTNPVAYEQYGSCAAAGGNHGNAEGGGTMN

SEQ ID NO: 201843 - protein, 33 aa, Artificial Sequence
  Description of Artificial Sequence: Synthetic polypeptide
DDSEVASTNPVSTEGWGNVWAAADIAERKGQYR

SEQ ID NO: 201844 - protein, 38 aa, Artificial Sequence
  Description of Artificial Sequence: Synthetic polypeptide
DEEEISTTNPCATEQYGQCVCPWGEDHNAEYFGSDTQA

SEQ ID NO: 201845 - protein, 35 aa, Artificial Sequence
  Description of Artificial Sequence: Synthetic polypeptide
DETEIRTTNPIATECWGAQTWANAEDWAEPKGPYI

SEQ ID NO: 201846 - protein, 37 aa, Artificial Sequence
  Description of Artificial Sequence: Synthetic polypeptide
DETEIATTNPVATEQWGCDCAGTGDHPGDNHPDDSNN

SEQ ID NO: 201847 - protein, 35 aa, Artificial Sequence
  Description of Artificial Sequence: Synthetic polypeptide
DETEIRTTNPIATECWGAQTWANAEDWAEPKGPYA

SEQ ID NO: 201848 - protein, 38 aa, Artificial Sequence
  Description of Artificial Sequence: Synthetic polypeptide
CDEEISTTNPVATEQYGQCVCSNWGEDNAENFNSDTQA

SEQ ID NO: 201849 - protein, 37 aa, Artificial Sequence
  Description of Artificial Sequence: Synthetic polypeptide
NEEEIACTNPVATESYGSACAAANPAEADAEIGNNTV

SEQ ID NO: 201850 - protein, 37 aa, Artificial Sequence
  Description of Artificial Sequence: Synthetic polypeptide
DETEIATTNPVATEQWGCNVAGAGEGPGIRHSGEEAP

SEQ ID NO: 201851 - protein, 39 aa, Artificial Sequence
  Description of Artificial Sequence: Synthetic polypeptide
DEAEIGTTNPVATEQYGQCVCSNWEEDHNAENFNSDTQS

SEQ ID NO: 201852 - protein, 37 aa, Artificial Sequence
  Description of Artificial Sequence: Synthetic polypeptide
QENEIRTTNPVATEQWGEVVDNEEGEEMGAGEGDGAQ

SEQ ID NO: 201853 - protein, 35 aa, Artificial Sequence
  Description of Artificial Sequence: Synthetic polypeptide
DETEIRTTNPIATECWGAMTWANAEDWAEPKGPYI

SEQ ID NO: 201854 - protein, 34 aa, Artificial Sequence
  Description of Artificial Sequence: Synthetic polypeptide
DDSEVASTNPVSTEGYGCVCANSEIIERFGSQQS

SEQ ID NO: 201855 - protein, 35 aa, Artificial Sequence
  Description of Artificial Sequence: Synthetic polypeptide
DETEIRTTNPIATECWGALTWLNAEDWAEPKGPYI

SEQ ID NO: 201856 - protein, 36 aa, Artificial Sequence
  Description of Artificial Sequence: Synthetic polypeptide
DEDEIATTNPVATAQWGGCCAGTGEHQIAEGQPMDN

SEQ ID NO: 201857 - protein, 35 aa, Artificial Sequence
  Description of Artificial Sequence: Synthetic polypeptide
DETEIRTTNPIATECWGALTWANAEDWAEPKGPYI

SEQ ID NO: 201858 - protein, 38 aa, Artificial Sequence
  Description of Artificial Sequence: Synthetic polypeptide
CDEEIRTTNPVAYEQYGQCVCSNWGPHNEENFNSDTQA

SEQ ID NO: 201859 - protein, 35 aa, Artificial Sequence
  Description of Artificial Sequence: Synthetic polypeptide
DETEIRTTNPIATEAWGATTWANAEDHAEPKGPYI

SEQ ID NO: 201860 - protein, 35 aa, Artificial Sequence
  Description of Artificial Sequence: Synthetic polypeptide
DETEIRTTNPIATECWGATGWANAEDWAEPKGPYI

SEQ ID NO: 201861 - protein, 38 aa, Artificial Sequence
  Description of Artificial Sequence: Synthetic polypeptide
NEEPIGATNPVATEQYGSCYTYPWPNDLGEGLFDSPQY

SEQ ID NO: 201862 - protein, 38 aa, Artificial Sequence
  Description of Artificial Sequence: Synthetic polypeptide
QEPEIQTTNPVATEQYGAIVTDNFNQMDQFEEGGQDGQ

SEQ ID NO: 201863 - protein, 36 aa, Artificial Sequence
  Description of Artificial Sequence: Synthetic polypeptide
NEMEISTTNPVATEGYGCVCGWGEHNAENFGSDTQS

SEQ ID NO: 201864 - protein, 37 aa, Artificial Sequence
  Description of Artificial Sequence: Synthetic polypeptide
TGEEIATTNPVAYEQWGVCVQNGGNAGEDLRREGQEP

SEQ ID NO: 201865 - protein, 36 aa, Artificial Sequence
  Description of Artificial Sequence: Synthetic polypeptide
DENCIATVNPVATECYGSVVCIDHQDQEQRQQDDKN

SEQ ID NO: 201866 - protein, 37 aa, Artificial Sequence
  Description of Artificial Sequence: Synthetic polypeptide
DEEEIACTNPVAYEQYGSCAAAGGNHGPNAEGEGESN

SEQ ID NO: 201867 - protein, 35 aa, Artificial Sequence
  Description of Artificial Sequence: Synthetic polypeptide
QEGEIAPTNPCSYECYGVTVSCLNMLSQGVVGTPK

SEQ ID NO: 201868 - protein, 38 aa, Artificial Sequence
  Description of Artificial Sequence: Synthetic polypeptide
DEAEIRTTNPVAYEQWGVACYTLDELHNDQNTQGQDDD

SEQ ID NO: 201869 - protein, 34 aa, Artificial Sequence
  Description of Artificial Sequence: Synthetic polypeptide
DETEIRTTNPIATECWGATTAAAEDWAEPKGPYI

SEQ ID NO: 201870 - protein, 37 aa, Artificial Sequence
  Description of Artificial Sequence: Synthetic polypeptide
CDEEISTTNPVATEQYGCVCQNWGEHNAENFNSDFQS

SEQ ID NO: 201871 - protein, 39 aa, Artificial Sequence
  Description of Artificial Sequence: Synthetic polypeptide
DEPEIRTTNCVATEQYGDYAVNMDTGINGEFGDAEGQQA

SEQ ID NO: 201872 - protein, 37 aa, Artificial Sequence
  Description of Artificial Sequence: Synthetic polypeptide
MEGEIRTTNPVATEQWGHAYCWACTNDMISFELEEHN

SEQ ID NO: 201873 - protein, 37 aa, Artificial Sequence
  Description of Artificial Sequence: Synthetic polypeptide
VEEEIACTNPVATEQYGSACAANPAEGQDHQDDSTAK

SEQ ID NO: 201874 - protein, 35 aa, Artificial Sequence
  Description of Artificial Sequence: Synthetic polypeptide
DEPEIRTTNPIATECWGATTWANAEDWAEPKGPYI

SEQ ID NO: 201875 - protein, 33 aa, Artificial Sequence
  Description of Artificial Sequence: Synthetic polypeptide
TEGEIACTNPCSYEQWGITCYCNDQQDTGDTRR

SEQ ID NO: 201876 - protein, 37 aa, Artificial Sequence
  Description of Artificial Sequence: Synthetic polypeptide
QAEEIATTNPVATEQYGCVAAGEGGHGNESAEEEGHY

SEQ ID NO: 201877 - protein, 36 aa, Artificial Sequence
  Description of Artificial Sequence: Synthetic polypeptide
DETEIATTNPVATASWGCVAAANWEVPDAGGENAGG

SEQ ID NO: 201878 - protein, 36 aa, Artificial Sequence
  Description of Artificial Sequence: Synthetic polypeptide
DETEIRTTNPIATECWGATSWANAEDWAEPKGPYIM

SEQ ID NO: 201879 - protein, 39 aa, Artificial Sequence
  Description of Artificial Sequence: Synthetic polypeptide
DEAAIRTTNPVATEQYGQCVCSNWGEDHNQENFNSDTQA

SEQ ID NO: 201880 - protein, 36 aa, Artificial Sequence
  Description of Artificial Sequence: Synthetic polypeptide
QEEEIATTNPVAYERYGEHAPWCEHEVSHSHAEGEW

SEQ ID NO: 201881 - protein, 37 aa, Artificial Sequence
  Description of Artificial Sequence: Synthetic polypeptide
QAEEIATTNPVATEQYGSACAANPALGIDHPDDTMAW

SEQ ID NO: 201882 - protein, 37 aa, Artificial Sequence
  Description of Artificial Sequence: Synthetic polypeptide
DEDEIATTNPVAYEQWGTIACAATAGELPDSASNPRS

SEQ ID NO: 201883 - protein, 40 aa, Artificial Sequence
  Description of Artificial Sequence: Synthetic polypeptide
DEEEIRTTNPVATEAYGTVVVTVTTTQAGTEAGTVTTQVE

SEQ ID NO: 201884 - protein, 35 aa, Artificial Sequence
  Description of Artificial Sequence: Synthetic polypeptide
DETEIRTTNPIATECWGATTAANAEDWAEPKGPYI

SEQ ID NO: 201885 - protein, 35 aa, Artificial Sequence
  Description of Artificial Sequence: Synthetic polypeptide
DETEIRTTNPIATEAWGANTWANAEDWEENQIPYI

SEQ ID NO: 201886 - protein, 36 aa, Artificial Sequence
  Description of Artificial Sequence: Synthetic polypeptide
TEGDEIATTNPCAYEAWGSVCFTIEGDDRMNGDGNE

SEQ ID NO: 201887 - protein, 35 aa, Artificial Sequence
  Description of Artificial Sequence: Synthetic polypeptide
DETEIRTTNPIATECWGATTAANAEDWAEPTGPYI

SEQ ID NO: 201888 - protein, 36 aa, Artificial Sequence
  Description of Artificial Sequence: Synthetic polypeptide
DETEIACTNPVATAQWGHSASLAGMGQSAEDPYENN

SEQ ID NO: 201889 - protein, 36 aa, Artificial Sequence
  Description of Artificial Sequence: Synthetic polypeptide
CEEEIACTNPVATEQYGSCAAGEAEGASDSGSGEAA

SEQ ID NO: 201890 - protein, 34 aa, Artificial Sequence
  Description of Artificial Sequence: Synthetic polypeptide
QENEIATTNPVAYAPWGNTVAGEGHLQHQMNMKM

SEQ ID NO: 201891 - protein, 35 aa, Artificial Sequence
  Description of Artificial Sequence: Synthetic polypeptide
DETEIRTTNPIATECWGATTANAEDWAEPKGEPYI

SEQ ID NO: 201892 - protein, 35 aa, Artificial Sequence
  Description of Artificial Sequence: Synthetic polypeptide
DETEIRTTNPIATECWGATTANAEDWAEPKGEPYG

SEQ ID NO: 201893 - protein, 38 aa, Artificial Sequence
  Description of Artificial Sequence: Synthetic polypeptide
TEGCAEIATTNPVAYEKWGSVCTIEDNEMTRTDRGTNN

SEQ ID NO: 201894 - protein, 38 aa, Artificial Sequence
  Description of Artificial Sequence: Synthetic polypeptide
TEGCAEIATTNPVAYEQWGSVCTIEDNEMDRTDRGTHN

SEQ ID NO: 201895 - protein, 37 aa, Artificial Sequence
  Description of Artificial Sequence: Synthetic polypeptide
TGQDEIATTNPVAYEQWGSCVQNGGNAGEDLNREGDP

SEQ ID NO: 201896 - protein, 36 aa, Artificial Sequence
  Description of Artificial Sequence: Synthetic polypeptide
QEGEIAPTNPCSYEQYGVVVASCLNMLSQGVGGTPP

SEQ ID NO: 201897 - protein, 34 aa, Artificial Sequence
  Description of Artificial Sequence: Synthetic polypeptide
DETEIRTTNPIATECWGATTANAEDWAEPAEPYI

SEQ ID NO: 201898 - protein, 36 aa, Artificial Sequence
  Description of Artificial Sequence: Synthetic polypeptide
DENEIATTNPVAYEQWGATYYSIEIEKMNQREMDYH

SEQ ID NO: 201899 - protein, 34 aa, Artificial Sequence
  Description of Artificial Sequence: Synthetic polypeptide
TGQDEIATTNPVAYEPWGVVTGGNQQDQTGDGPT

SEQ ID NO: 201900 - protein, 35 aa, Artificial Sequence
  Description of Artificial Sequence: Synthetic polypeptide
DETEIRTTNPIATECWGATTANAEDEAEPKGEPYI

SEQ ID NO: 201901 - protein, 37 aa, Artificial Sequence
  Description of Artificial Sequence: Synthetic polypeptide
DEAEIRTTNCVAYCQYGCVCSNWMEDNQEYFGSDTQS

SEQ ID NO: 201902 - protein, 35 aa, Artificial Sequence
  Description of Artificial Sequence: Synthetic polypeptide
DETEIRTTNPIATECWGATTANAEDEAEPKGEPYG

SEQ ID NO: 201903 - protein, 36 aa, Artificial Sequence
  Description of Artificial Sequence: Synthetic polypeptide
AEECISTTNPVATEGYGCVCNWGEAHNQYFGSDTQS

SEQ ID NO: 201904 - protein, 35 aa, Artificial Sequence
  Description of Artificial Sequence: Synthetic polypeptide
DETEIRTTNPIATECWGATTANAEDEADPKGEPYG

SEQ ID NO: 201905 - protein, 38 aa, Artificial Sequence
  Description of Artificial Sequence: Synthetic polypeptide
QEGEINTTNPVATEQYGYISFSAPPDTLREPHEIEDTR

SEQ ID NO: 201906 - protein, 36 aa, Artificial Sequence
  Description of Artificial Sequence: Synthetic polypeptide
CEDEIACTNPVATEQWGCFVATGEDASIGNSDESAM

SEQ ID NO: 201907 - protein, 37 aa, Artificial Sequence
  Description of Artificial Sequence: Synthetic polypeptide
MEGEIRTTNPVATECYGCNCNNTVELLSDGTGFEQGF

SEQ ID NO: 201908 - protein, 39 aa, Artificial Sequence
  Description of Artificial Sequence: Synthetic polypeptide
MEGEIRTTNPVATEQFGSCCSSPAPEEGPNMVFEGNSDC

SEQ ID NO: 201909 - protein, 35 aa, Artificial Sequence
  Description of Artificial Sequence: Synthetic polypeptide
DEDEIRTTNPIATECWGATTWANAEDWAEPKGPYI

SEQ ID NO: 201910 - protein, 35 aa, Artificial Sequence
  Description of Artificial Sequence: Synthetic polypeptide
DETEIRTTNPIATECWGATTAAPATDWAEPKGPYI

SEQ ID NO: 201911 - protein, 35 aa, Artificial Sequence
  Description of Artificial Sequence: Synthetic polypeptide
DEDEIRTTNPIATECWGATTWANDEDWAEPKGPYI

SEQ ID NO: 201912 - protein, 38 aa, Artificial Sequence
  Description of Artificial Sequence: Synthetic polypeptide
DENEISCTNPVATEQYGQCVCSNWGEHNAENFNSETQA

SEQ ID NO: 201913 - protein, 34 aa, Artificial Sequence
  Description of Artificial Sequence: Synthetic polypeptide
DDSEVASTNPVSTEGYGCVCENSEIQEHFGSQQS

SEQ ID NO: 201914 - protein, 36 aa, Artificial Sequence
  Description of Artificial Sequence: Synthetic polypeptide
CEDEIACTNPVATEQWGCFVATGELAGINNSDESAM

SEQ ID NO: 201915 - protein, 34 aa, Artificial Sequence
  Description of Artificial Sequence: Synthetic polypeptide
DDSEVASTNPVSTEGYGCVCAYWEIQERFGSQQS

SEQ ID NO: 201916 - protein, 39 aa, Artificial Sequence
  Description of Artificial Sequence: Synthetic polypeptide
DESEISTTNPVATEGYGVVDVGVGTGNVGQEEGEGEDTI

SEQ ID NO: 201917 - protein, 37 aa, Artificial Sequence
  Description of Artificial Sequence: Synthetic polypeptide
DEEEIATTNPVAYEQWGHSACAAANPLAAAPIEDSFQ

SEQ ID NO: 201918 - protein, 38 aa, Artificial Sequence
  Description of Artificial Sequence: Synthetic polypeptide
DEAEIRTTNCVAYCQYGCVCSNWGEDHNAEYFGSDNQS

SEQ ID NO: 201919 - protein, 36 aa, Artificial Sequence
  Description of Artificial Sequence: Synthetic polypeptide
VEEEIATTNPVATASWGCVSATGAGGTAPQDIADFN

SEQ ID NO: 201920 - protein, 38 aa, Artificial Sequence
  Description of Artificial Sequence: Synthetic polypeptide
MEGEIRTTNPVATEQYGCVVGSPMDGLSSEEDFVSFQQ

SEQ ID NO: 201921 - protein, 37 aa, Artificial Sequence
  Description of Artificial Sequence: Synthetic polypeptide
DETEIACTNPVATAQWGSVSVSGNPEENTGGMSEESF

SEQ ID NO: 201922 - protein, 35 aa, Artificial Sequence
  Description of Artificial Sequence: Synthetic polypeptide
DETEIRTTNPIATECWGATIWANAEDWAGPKGPYI

SEQ ID NO: 201923 - protein, 37 aa, Artificial Sequence
  Description of Artificial Sequence: Synthetic polypeptide
DEAEIRTTNCVAYCGYGCVCSNWGEHNQEYFGSDNQA

SEQ ID NO: 201924 - protein, 36 aa, Artificial Sequence
  Description of Artificial Sequence: Synthetic polypeptide
DEDEIATTNPVAYEQWGTNCAATAGEDPDSKGNNEH

SEQ ID NO: 201925 - protein, 35 aa, Artificial Sequence
  Description of Artificial Sequence: Synthetic polypeptide
DETEIRTTNPIATECWGATIWANAEDWAEPKGPYI

SEQ ID NO: 201926 - protein, 35 aa, Artificial Sequence
  Description of Artificial Sequence: Synthetic polypeptide
DETEIRTTNPIATEAWGATTPANCEDWAEINGPAV

SEQ ID NO: 201927 - protein, 32 aa, Artificial Sequence
  Description of Artificial Sequence: Synthetic polypeptide
QESEIASTNPIGTEGWGATANSTWAEPKGPYI

SEQ ID NO: 201928 - protein, 38 aa, Artificial Sequence
  Description of Artificial Sequence: Synthetic polypeptide
CDEEISTTNPVATEQYGQCVCSMWGEHNQEHFISDNQA

SEQ ID NO: 201929 - protein, 37 aa, Artificial Sequence
  Description of Artificial Sequence: Synthetic polypeptide
DEAEIRTTNCVAYCGYGCVCSNWGEDNAEYFGSDNQS

SEQ ID NO: 201930 - protein, 36 aa, Artificial Sequence
  Description of Artificial Sequence: Synthetic polypeptide
DEDEIATTNPVAYEQWGTNCAATAGEEPDSQNPNEH

SEQ ID NO: 201931 - protein, 37 aa, Artificial Sequence
  Description of Artificial Sequence: Synthetic polypeptide
DETEIACTNPVATEMWGSVVANMGAPGFNTHGGTEMW

SEQ ID NO: 201932 - protein, 36 aa, Artificial Sequence
  Description of Artificial Sequence: Synthetic polypeptide
QENEIATTNPVAYEPYGNTVAGEHLNQNHGMEMQEN

SEQ ID NO: 201933 - protein, 37 aa, Artificial Sequence
  Description of Artificial Sequence: Synthetic polypeptide
QAEEIATTNPVATEQYGCVAAGEGGHGNESGEEEGME

SEQ ID NO: 201934 - protein, 36 aa, Artificial Sequence
  Description of Artificial Sequence: Synthetic polypeptide
DEDEIATTNPVAYEQWGTNCAATAGELPDSDPNDSP

SEQ ID NO: 201935 - protein, 36 aa, Artificial Sequence
  Description of Artificial Sequence: Synthetic polypeptide
CEDEIACTNPVATEQWGCNVANGELADIGNSDESAM

SEQ ID NO: 201936 - protein, 38 aa, Artificial Sequence
  Description of Artificial Sequence: Synthetic polypeptide
DEDEIATTNPVAYEQWGTVSGGEPGNGGNMRREMEDMR

SEQ ID NO: 201937 - protein, 35 aa, Artificial Sequence
  Description of Artificial Sequence: Synthetic polypeptide
DETEIRTTNPIATECWGATHWANAEDWAEPKGPYI

SEQ ID NO: 201938 - protein, 37 aa, Artificial Sequence
  Description of Artificial Sequence: Synthetic polypeptide
DETEIACTNPVATEPYGSACAAANPAEADAEIGNDTQ

SEQ ID NO: 201939 - protein, 36 aa, Artificial Sequence
  Description of Artificial Sequence: Synthetic polypeptide
DEDEIATTNPVAYEQWGTNCAATAGEDPDSGPNDTL

SEQ ID NO: 201940 - protein, 37 aa, Artificial Sequence
  Description of Artificial Sequence: Synthetic polypeptide
DEDEIACTNPVATESYGSACAAANPAEADAEIGNETA

SEQ ID NO: 201941 - protein, 38 aa, Artificial Sequence
  Description of Artificial Sequence: Synthetic polypeptide
CDEEISTTNPVATEQYGQCVCSWGEDHNAEYFNSDTQS

SEQ ID NO: 201942 - protein, 36 aa, Artificial Sequence
  Description of Artificial Sequence: Synthetic polypeptide
DESEISTTNPVATEGWGCVCSWGEENQEYFISDTQA

SEQ ID NO: 201943 - protein, 35 aa, Artificial Sequence
  Description of Artificial Sequence: Synthetic polypeptide
DETEIRTTNPIATECWGATQWANAEDWPEPKGPYI

SEQ ID NO: 201944 - protein, 38 aa, Artificial Sequence
  Description of Artificial Sequence: Synthetic polypeptide
DDEEIRTTNPVATEGWGQCVTSNWGEDNQENFNSDTAS

SEQ ID NO: 201945 - protein, 35 aa, Artificial Sequence
  Description of Artificial Sequence: Synthetic polypeptide
DETEIRTTNPIATECWGATQWANAEDWAEPKGPYI

SEQ ID NO: 201946 - protein, 35 aa, Artificial Sequence
  Description of Artificial Sequence: Synthetic polypeptide
DETEIRTTNPIATECWGATQWANAEDTAEPKGPYI

SEQ ID NO: 201947 - protein, 35 aa, Artificial Sequence
  Description of Artificial Sequence: Synthetic polypeptide
DETEIRTTNPIATECWGATPWANAEDWAEPKGPYI

SEQ ID NO: 201948 - protein, 37 aa, Artificial Sequence
  Description of Artificial Sequence: Synthetic polypeptide
DESEISTTNPVATEGWGQCVCSWGEENQEYFGSQTQS

SEQ ID NO: 201949 - protein, 36 aa, Artificial Sequence
  Description of Artificial Sequence: Synthetic polypeptide
CEDEIACTNPVATEQWGCFVATGEPADIGNSDEAAM

SEQ ID NO: 201950 - protein, 35 aa, Artificial Sequence
  Description of Artificial Sequence: Synthetic polypeptide
DETEIRTTNPIATEAWGATTAANAEDWAEPKGPYI

SEQ ID NO: 201951 - protein, 38 aa, Artificial Sequence
  Description of Artificial Sequence: Synthetic polypeptide
NDECIRTTNPVATEQYGQCVCSNWGEHNQENFGSDTQS

SEQ ID NO: 201952 - protein, 38 aa, Artificial Sequence
  Description of Artificial Sequence: Synthetic polypeptide
DEDEIATTNPVAYEQWGTIICPAVADAGQDHQGDNAER

SEQ ID NO: 201953 - protein, 37 aa, Artificial Sequence
  Description of Artificial Sequence: Synthetic polypeptide
DETEIATTNPVATEQWGTVAAQAPGTDAGAPMGEGTW

SEQ ID NO: 201954 - protein, 34 aa, Artificial Sequence
  Description of Artificial Sequence: Synthetic polypeptide
QENEIATTNPVAYEPWGNVSGEHLNNNHMEMQLN

SEQ ID NO: 201955 - protein, 35 aa, Artificial Sequence
  Description of Artificial Sequence: Synthetic polypeptide
DETEIRTTNPIATECWGATNWANAEDMAEPKGPYI

SEQ ID NO: 201956 - protein, 35 aa, Artificial Sequence
  Description of Artificial Sequence: Synthetic polypeptide
DETEIRTTNPIATECWGATNWANAEDGAEPKGPYI

SEQ ID NO: 201957 - protein, 35 aa, Artificial Sequence
  Description of Artificial Sequence: Synthetic polypeptide
DETEIRTTNPIATECWGATMWANAEDWAEPKGPYI

SEQ ID NO: 201958 - protein, 36 aa, Artificial Sequence
  Description of Artificial Sequence: Synthetic polypeptide
CEDEIACTNPVATEQWGCIFATGQNPETLENGEEAM

SEQ ID NO: 201959 - protein, 35 aa, Artificial Sequence
  Description of Artificial Sequence: Synthetic polypeptide
DETEIRTTNPIATECWGATMWANAEDWAEPKGLYI

SEQ ID NO: 201960 - protein, 38 aa, Artificial Sequence
  Description of Artificial Sequence: Synthetic polypeptide
AEEEIATTNPVATEQYGCSCFNWGEDDNQEHFISENQA

SEQ ID NO: 201961 - protein, 35 aa, Artificial Sequence
  Description of Artificial Sequence: Synthetic polypeptide
TGEAEIATTNPCAYEHWGSVCYNNDDQDHGQGDSA

SEQ ID NO: 201962 - protein, 35 aa, Artificial Sequence
  Description of Artificial Sequence: Synthetic polypeptide
DETEIRTTNPIATECWGATLWNNAEDWAEPKGPYI

SEQ ID NO: 201963 - protein, 35 aa, Artificial Sequence
  Description of Artificial Sequence: Synthetic polypeptide
DETEIRTTNPIATECWGATLWANAEDWAEPKGPYI

SEQ ID NO: 201964 - protein, 37 aa, Artificial Sequence
  Description of Artificial Sequence: Synthetic polypeptide
CEEEIACTNPVATEQYGSCAAAVGNEEMIAEMSNEAA

SEQ ID NO: 201965 - protein, 35 aa, Artificial Sequence
  Description of Artificial Sequence: Synthetic polypeptide
DETEIRTTNPIATECWGATKWANAEDHAEPKGPYI

SEQ ID NO: 201966 - protein, 35 aa, Artificial Sequence
  Description of Artificial Sequence: Synthetic polypeptide
DETEIRTTNPIATECWGATNWANAEDWAEPKGPYI

SEQ ID NO: 201967 - protein, 38 aa, Artificial Sequence
  Description of Artificial Sequence: Synthetic polypeptide
DEEEISTTNPEATEQYGQCVCPNWMEDNAENFNSDTQS

SEQ ID NO: 201968 - protein, 38 aa, Artificial Sequence
  Description of Artificial Sequence: Synthetic polypeptide
DETEIRTTNPCATEAYGVVATTNANANETGTEEGTIYT

SEQ ID NO: 201969 - protein, 35 aa, Artificial Sequence
  Description of Artificial Sequence: Synthetic polypeptide
DETEIRTTNPIATECWGATTQRNAEDWAEPKGPYI

SEQ ID NO: 201970 - protein, 35 aa, Artificial Sequence
  Description of Artificial Sequence: Synthetic polypeptide
DETEIRTTNPIATECWGATTWANAEDMAEPKGPYI

SEQ ID NO: 201971 - protein, 36 aa, Artificial Sequence
  Description of Artificial Sequence: Synthetic polypeptide
DETEIRTTNPIATECWGATTWANAEDLWAEPKGPYI

SEQ ID NO: 201972 - protein, 36 aa, Artificial Sequence
  Description of Artificial Sequence: Synthetic polypeptide
DETEIRTTNPIATECWGATTWANAEDLWAEPKGPEI

SEQ ID NO: 201973 - protein, 39 aa, Artificial Sequence
  Description of Artificial Sequence: Synthetic polypeptide
AEEEIATTNPVATEQYGQCSCPNSGEDDNQEHFNSENQA

SEQ ID NO: 201974 - protein, 39 aa, Artificial Sequence
  Description of Artificial Sequence: Synthetic polypeptide
DEEEISTTNPVATEGYGQCVCSNWGEDDNIENFNSQNQS

SEQ ID NO: 201975 - protein, 39 aa, Artificial Sequence
  Description of Artificial Sequence: Synthetic polypeptide
DEEEISTTNPVATEGYGQCVCSNWGEDDNAENFNSETQQ

SEQ ID NO: 201976 - protein, 38 aa, Artificial Sequence
  Description of Artificial Sequence: Synthetic polypeptide
QEEEIRATNPVATDQYGMITVNMGMEDINEEGGNEGDG

SEQ ID NO: 201977 - protein, 37 aa, Artificial Sequence
  Description of Artificial Sequence: Synthetic polypeptide
AEEEIATTNPVATEQYGICYCPWGEDNIEHFNSETQA

SEQ ID NO: 201978 - protein, 37 aa, Artificial Sequence
  Description of Artificial Sequence: Synthetic polypeptide
AEVEISTTNPVATEQWGCVHPDVYYHNSQPELQVESI

SEQ ID NO: 201979 - protein, 39 aa, Artificial Sequence
  Description of Artificial Sequence: Synthetic polypeptide
DETEIRSTNPVATDQYGVVNDNSIGQNTGGQEENDDTDG

SEQ ID NO: 201980 - protein, 39 aa, Artificial Sequence
  Description of Artificial Sequence: Synthetic polypeptide
DEEEISCTNPVATEQYGQCVCSMWEEDDNAEGFGSDTQA

SEQ ID NO: 201981 - protein, 35 aa, Artificial Sequence
  Description of Artificial Sequence: Synthetic polypeptide
DETEIRTTNPIATECWGATTWANAEDKAEPKGPYI

SEQ ID NO: 201982 - protein, 35 aa, Artificial Sequence
  Description of Artificial Sequence: Synthetic polypeptide
DETEIRTTNPIATECWGATTWANAEDKAEPKGPCI

SEQ ID NO: 201983 - protein, 35 aa, Artificial Sequence
  Description of Artificial Sequence: Synthetic polypeptide
DETEIRTTNPIATECWGATTWANAEDKAEPFGPYI

SEQ ID NO: 201984 - protein, 38 aa, Artificial Sequence
  Description of Artificial Sequence: Synthetic polypeptide
QAEEIATTNPVATEQYGSVCAMANHADNSKAPGAGLHN

SEQ ID NO: 201985 - protein, 36 aa, Artificial Sequence
  Description of Artificial Sequence: Synthetic polypeptide
DETEIRTTNPIATECWGATTWANAEDIQAEPNGPYI

SEQ ID NO: 201986 - protein, 38 aa, Artificial Sequence
  Description of Artificial Sequence: Synthetic polypeptide
DASCEIATTNPVAYEQWGSVCAPTEGGNNAVGNDNMAD

SEQ ID NO: 201987 - protein, 39 aa, Artificial Sequence
  Description of Artificial Sequence: Synthetic polypeptide
AEEAIRTTNPVATEQYGQCVCSNWGEDHNTENFNSDTQQ

SEQ ID NO: 201988 - protein, 38 aa, Artificial Sequence
  Description of Artificial Sequence: Synthetic polypeptide
DEEEISCTNPVATEQYGQCVCSMWGEDNAENFISDTQA

SEQ ID NO: 201989 - protein, 36 aa, Artificial Sequence
  Description of Artificial Sequence: Synthetic polypeptide
DESAEIATTNPCAYECWGCVATPNGNQQLEGDHGGH

SEQ ID NO: 201990 - protein, 35 aa, Artificial Sequence
  Description of Artificial Sequence: Synthetic polypeptide
DETEIRTTNPIATECWGATTWANAEDIAEPNGPYI

SEQ ID NO: 201991 - protein, 39 aa, Artificial Sequence
  Description of Artificial Sequence: Synthetic polypeptide
DEEEISTTNPVATEGYGQCVCSNWEEPHNAENFNSDTQA

SEQ ID NO: 201992 - protein, 36 aa, Artificial Sequence
  Description of Artificial Sequence: Synthetic polypeptide
QEEEIATTNPVAYEQYGEHAPWCEGHEPSQHAEGEW

SEQ ID NO: 201993 - protein, 36 aa, Artificial Sequence
  Description of Artificial Sequence: Synthetic polypeptide
DETEIATTNPIATECWGATYYTNENDQHEKTGVKGM

SEQ ID NO: 201994 - protein, 38 aa, Artificial Sequence
  Description of Artificial Sequence: Synthetic polypeptide
DEEEISTTNPVATEGYGCVCGNWGEDHNAENFNSENQA

SEQ ID NO: 201995 - protein, 35 aa, Artificial Sequence
  Description of Artificial Sequence: Synthetic polypeptide
DETEIRTTNPIATECWGATTWANAEDNAEPKGPYI

SEQ ID NO: 201996 - protein, 39 aa, Artificial Sequence
  Description of Artificial Sequence: Synthetic polypeptide
MEGEIRTTNPVATEQYGSIVNMWPFEEDDGQDSGQYDTG

SEQ ID NO: 201997 - protein, 34 aa, Artificial Sequence
  Description of Artificial Sequence: Synthetic polypeptide
DETEIRSTNPIATECWGATVANAEDWAEPKGPYI

SEQ ID NO: 201998 - protein, 35 aa, Artificial Sequence
  Description of Artificial Sequence: Synthetic polypeptide
DETEIRTTNPIATECWGATTWANAEDSAEPKGPYI

SEQ ID NO: 201999 - protein, 34 aa, Artificial Sequence
  Description of Artificial Sequence: Synthetic polypeptide
DENEIACTNPIATECWGATTWANAEDLAEPKGPI

SEQ ID NO: 202000 - protein, 35 aa, Artificial Sequence
  Description of Artificial Sequence: Synthetic polypeptide
DEEEIACTNPVAYEPWGHSPASLAGMGQAEDPMEN

SEQ ID NO: 202001 - protein, 38 aa, Artificial Sequence
  Description of Artificial Sequence: Synthetic polypeptide
DEDEIATTNPVAYEQWGSVCSPANPALYNEHMIDLTAM

SEQ ID NO: 202002 - protein, 38 aa, Artificial Sequence
  Description of Artificial Sequence: Synthetic polypeptide
DETEIRSTNPVATDQYGVVNDNSIGQNGGQEDADDTTG

SEQ ID NO: 202003 - protein, 35 aa, Artificial Sequence
  Description of Artificial Sequence: Synthetic polypeptide
DETEIATTNPIATECWGATYYANENDQNEHTGKTM

SEQ ID NO: 202004 - protein, 39 aa, Artificial Sequence
  Description of Artificial Sequence: Synthetic polypeptide
DEEEISCTNPVATEQYGQCQVCSNWGEHNAENFNSDFQS

SEQ ID NO: 202005 - protein, 35 aa, Artificial Sequence
  Description of Artificial Sequence: Synthetic polypeptide
DETEIRTTNPIATECWGATTWANAEDSAEPCGKYI

SEQ ID NO: 202006 - protein, 39 aa, Artificial Sequence
  Description of Artificial Sequence: Synthetic polypeptide
DEEEISCTNPVATEQYGQCQVCSNWGEHNAENFNSDNQA

SEQ ID NO: 202007 - protein, 40 aa, Artificial Sequence
  Description of Artificial Sequence: Synthetic polypeptide
DEMEIRTTNPVATECYGQAIVWSREMLESELDRFDGSIME

SEQ ID NO: 202008 - protein, 39 aa, Artificial Sequence
  Description of Artificial Sequence: Synthetic polypeptide
DEEEISCTNPVATEQYGQCQVCSNWGEHNTENFNSDTQA

SEQ ID NO: 202009 - protein, 36 aa, Artificial Sequence
  Description of Artificial Sequence: Synthetic polypeptide
DETEIRTTNPIATECWGATTWANAEDRWAEPKGPYI

SEQ ID NO: 202010 - protein, 38 aa, Artificial Sequence
  Description of Artificial Sequence: Synthetic polypeptide
DESEIRTTNPVAYEQWGVACYTGDNLHNDQMTQKQDDD

SEQ ID NO: 202011 - protein, 40 aa, Artificial Sequence
  Description of Artificial Sequence: Synthetic polypeptide
DEMEIRTTNPVATECYGQTIVNSRVMLESELDRFDGSIME

SEQ ID NO: 202012 - protein, 38 aa, Artificial Sequence
  Description of Artificial Sequence: Synthetic polypeptide
DEEEISTTNPVATEGYGCVCGNWGEDHNAENFNSDTQS

SEQ ID NO: 202013 - protein, 37 aa, Artificial Sequence
  Description of Artificial Sequence: Synthetic polypeptide
AEEEIATTNPVATEQWGCSCPNWGEDNAEHFISENQA

SEQ ID NO: 202014 - protein, 36 aa, Artificial Sequence
  Description of Artificial Sequence: Synthetic polypeptide
DETEIRTTNPIATECWGATTWANAEDRAEPKGHPYI

SEQ ID NO: 202015 - protein, 36 aa, Artificial Sequence
  Description of Artificial Sequence: Synthetic polypeptide
DETEIRTTNPIATECWGATTWANAEDQWAEPKGPYI

SEQ ID NO: 202016 - protein, 36 aa, Artificial Sequence
  Description of Artificial Sequence: Synthetic polypeptide
DETEIRTTNPIATECWGATTWANAEDQTAENMGKYI

SEQ ID NO: 202017 - protein, 36 aa, Artificial Sequence
  Description of Artificial Sequence: Synthetic polypeptide
DETEIRTTNPIATECWGATTWANAEDQMAEPKGPYI

SEQ ID NO: 202018 - protein, 35 aa, Artificial Sequence
  Description of Artificial Sequence: Synthetic polypeptide
DETEIATTNPIATECWGATYYANEVDQDEKKGDTV

SEQ ID NO: 202019 - protein, 40 aa, Artificial Sequence
  Description of Artificial Sequence: Synthetic polypeptide
CEAEIRTTNPVATEQYGDVVQGSGQEDQEEGDGEGEGNGV

SEQ ID NO: 202020 - protein, 35 aa, Artificial Sequence
  Description of Artificial Sequence: Synthetic polypeptide
DETEIRTTNPIATECWGATTWANAEDPAEPKGPYI

SEQ ID NO: 202021 - protein, 39 aa, Artificial Sequence
  Description of Artificial Sequence: Synthetic polypeptide
DEEEISTTNPVATEGYGQCVCSNWGEDHNAEFFNSDTQS

SEQ ID NO: 202022 - protein, 35 aa, Artificial Sequence
  Description of Artificial Sequence: Synthetic polypeptide
DETEIRTTNPIATECWGATTWANAEDIAEPKGPYI

SEQ ID NO: 202023 - protein, 39 aa, Artificial Sequence
  Description of Artificial Sequence: Synthetic polypeptide
DEEEISCTNPVATEQYGQCVCSNWEELHNAENFNSDNQS

SEQ ID NO: 202024 - protein, 39 aa, Artificial Sequence
  Description of Artificial Sequence: Synthetic polypeptide
DEEEISCTNPVATEQYGQCVCSNWGEDHNAENFNSDTQA

SEQ ID NO: 202025 - protein, 36 aa, Artificial Sequence
  Description of Artificial Sequence: Synthetic polypeptide
QEEEIATTNPVAYEWYGEHAPHCVHEFSQSHNEGEW

SEQ ID NO: 202026 - protein, 35 aa, Artificial Sequence
  Description of Artificial Sequence: Synthetic polypeptide
DETEIRTTNPIATECWGATTWANAEDCAEPKGPYI

SEQ ID NO: 202027 - protein, 35 aa, Artificial Sequence
  Description of Artificial Sequence: Synthetic polypeptide
DETEIRTTNPIATECWGATTWANAEDAWAEPGPYI

SEQ ID NO: 202028 - protein, 38 aa, Artificial Sequence
  Description of Artificial Sequence: Synthetic polypeptide
DETEIACTNPVATEQYGSACPATNPHEEAEAPQDNMAH

SEQ ID NO: 202029 - protein, 35 aa, Artificial Sequence
  Description of Artificial Sequence: Synthetic polypeptide
DETEIRTTNPIATECWGATTWANAEDAAEPKGPYI

SEQ ID NO: 202030 - protein, 35 aa, Artificial Sequence
  Description of Artificial Sequence: Synthetic polypeptide
QEEEIATTNPVAYEWYGEHAPCCEHEFSQHAEGEW

SEQ ID NO: 202031 - protein, 38 aa, Artificial Sequence
  Description of Artificial Sequence: Synthetic polypeptide
DEEEISCTNPVATEQYGQCVCSNWGEDNAEYFISDTQA

SEQ ID NO: 202032 - protein, 35 aa, Artificial Sequence
  Description of Artificial Sequence: Synthetic polypeptide
DETEIRTTNPIATECWGATTWANAEDAAEPGGPYI

SEQ ID NO: 202033 - protein, 38 aa, Artificial Sequence
  Description of Artificial Sequence: Synthetic polypeptide
DESEIRTTNPVATEGWGCVCSMWGEDENQEYFGSDTQA

SEQ ID NO: 202034 - protein, 37 aa, Artificial Sequence
  Description of Artificial Sequence: Synthetic polypeptide
DETEIRTTNPCATEAWGCQTCGNAEEHNAEYSGSDNI

SEQ ID NO: 202035 - protein, 36 aa, Artificial Sequence
  Description of Artificial Sequence: Synthetic polypeptide
CEEEIACTNPVATEQYGSCAAAGPAEGADSVSDEDA

SEQ ID NO: 202036 - protein, 38 aa, Artificial Sequence
  Description of Artificial Sequence: Synthetic polypeptide
DEMEIRTTNPVATEQYGCCLEPVIHERCEHGFSETPQF

SEQ ID NO: 202037 - protein, 39 aa, Artificial Sequence
  Description of Artificial Sequence: Synthetic polypeptide
DEEEISTTNPVATEGYGQCVCSNWEEDHNAENFNSDNQA

SEQ ID NO: 202038 - protein, 36 aa, Artificial Sequence
  Description of Artificial Sequence: Synthetic polypeptide
QEEEIATTNPVAYEQYGEHAPWCEHEFSQHAEGEGG

SEQ ID NO: 202039 - protein, 37 aa, Artificial Sequence
  Description of Artificial Sequence: Synthetic polypeptide
AEEAIRTTNPVATEEYGCSCSNWGEHNAEYFISDTQA

SEQ ID NO: 202040 - protein, 36 aa, Artificial Sequence
  Description of Artificial Sequence: Synthetic polypeptide
DETEIATTNPIATECWGVTTWANATDGPAEPNNPYN

SEQ ID NO: 202041 - protein, 35 aa, Artificial Sequence
  Description of Artificial Sequence: Synthetic polypeptide
DETEIRTTNPIATECWGATTWANAECWAEPKGPYI

SEQ ID NO: 202042 - protein, 37 aa, Artificial Sequence
  Description of Artificial Sequence: Synthetic polypeptide
DENEIRTTNPVSYEGYGCICSTWEEDNAEYFNSDTQA

SEQ ID NO: 202043 - protein, 37 aa, Artificial Sequence
  Description of Artificial Sequence: Synthetic polypeptide
VEDEIACTNPVAYEQYGSVCSAVGNDGNTEHPTGQLN

SEQ ID NO: 202044 - protein, 38 aa, Artificial Sequence
  Description of Artificial Sequence: Synthetic polypeptide
DENEIATTNPVAYAQWGSVCSEANPALPNDHGGGMEHW

SEQ ID NO: 202045 - protein, 35 aa, Artificial Sequence
  Description of Artificial Sequence: Synthetic polypeptide
DETEIRTTNPIATECWGATTWANAEAWAEPKGPYI

SEQ ID NO: 202046 - protein, 35 aa, Artificial Sequence
  Description of Artificial Sequence: Synthetic polypeptide
DETEIRTTNPIATECWGATTWANAEAWAEPDGPYI

SEQ ID NO: 202047 - protein, 36 aa, Artificial Sequence
  Description of Artificial Sequence: Synthetic polypeptide
DETEIRTTNPCATEAWGCQTCANAEDDAENSGSENI

SEQ ID NO: 202048 - protein, 39 aa, Artificial Sequence
  Description of Artificial Sequence: Synthetic polypeptide
DEEEISCTNPVATEQYGQCVCSNSGEDHNAEHFNSDTQS

SEQ ID NO: 202049 - protein, 35 aa, Artificial Sequence
  Description of Artificial Sequence: Synthetic polypeptide
DETEIRTTNPIATECWGATTWANAEDDAEIKGPYI

SEQ ID NO: 202050 - protein, 35 aa, Artificial Sequence
  Description of Artificial Sequence: Synthetic polypeptide
DETEIRTTNPIATECWGATTWANAEDEAEPKGPYI

SEQ ID NO: 202051 - protein, 35 aa, Artificial Sequence
  Description of Artificial Sequence: Synthetic polypeptide
DETEIRTTNPIATECWGATTWANAEDIAEPKGPGI

SEQ ID NO: 202052 - protein, 35 aa, Artificial Sequence
  Description of Artificial Sequence: Synthetic polypeptide
DETEIRTTNPIATECWGATTWANAEDIAEGKGPDI

SEQ ID NO: 202053 - protein, 39 aa, Artificial Sequence
  Description of Artificial Sequence: Synthetic polypeptide
DEEEISCTNPVATEQYGQCVCSNWGEDDNQENFNSDTQA

SEQ ID NO: 202054 - protein, 35 aa, Artificial Sequence
  Description of Artificial Sequence: Synthetic polypeptide
QEEEIATTNPVAYEQYGEHAPWCEHEFSDHTEGEW

SEQ ID NO: 202055 - protein, 38 aa, Artificial Sequence
  Description of Artificial Sequence: Synthetic polypeptide
CDECISTTNPVATEQYGCVCSNWGEDHNAENFGSDNQS

SEQ ID NO: 202056 - protein, 38 aa, Artificial Sequence
  Description of Artificial Sequence: Synthetic polypeptide
VEDEIACTNPVAYEQYGSVCSAANPAATNAHGGDLEAM

SEQ ID NO: 202057 - protein, 39 aa, Artificial Sequence
  Description of Artificial Sequence: Synthetic polypeptide
DEEEISCTNPVATEQYGQCVCSNWGEDHNAEHFNSDTQA

SEQ ID NO: 202058 - protein, 39 aa, Artificial Sequence
  Description of Artificial Sequence: Synthetic polypeptide
DEEEISCTNPVATEQYGQCVCSNWGEDHNAENFNSDNQF

SEQ ID NO: 202059 - protein, 35 aa, Artificial Sequence
  Description of Artificial Sequence: Synthetic polypeptide
DETEIRTTNPIATECWGATTWANAEDHAEPKGPYI

SEQ ID NO: 202060 - protein, 38 aa, Artificial Sequence
  Description of Artificial Sequence: Synthetic polypeptide
QAEEIATTNPVATEQYGCVAPGEGTHGQNESAEEAENG

SEQ ID NO: 202061 - protein, 34 aa, Artificial Sequence
  Description of Artificial Sequence: Synthetic polypeptide
AESEIASTNPVGTEGWGVCAPTDRDQHQRQDDIR

SEQ ID NO: 202062 - protein, 38 aa, Artificial Sequence
  Description of Artificial Sequence: Synthetic polypeptide
QEGEIATTNPVACEQYGIISFSAPEDTLREPHEGEDTR

SEQ ID NO: 202063 - protein, 37 aa, Artificial Sequence
  Description of Artificial Sequence: Synthetic polypeptide
VEDEIACTNPVAYEQYGSVCSAANPPAIAHGGDLEAM

SEQ ID NO: 202064 - protein, 35 aa, Artificial Sequence
  Description of Artificial Sequence: Synthetic polypeptide
DETEIRTTNPIATECWGATTWANAEDGAEPKKPYI

SEQ ID NO: 202065 - protein, 35 aa, Artificial Sequence
  Description of Artificial Sequence: Synthetic polypeptide
DETEIRTTNPIATECWGATTWANAEDGAEPKGPYI

SEQ ID NO: 202066 - protein, 35 aa, Artificial Sequence
  Description of Artificial Sequence: Synthetic polypeptide
DETEIRTTNPIATECWGATTWANAEDGAEPKGPFI

SEQ ID NO: 202067 - protein, 33 aa, Artificial Sequence
  Description of Artificial Sequence: Synthetic polypeptide
AESEIASTNPVGTEGWGVCAPTDRDQKQGQDDI

SEQ ID NO: 202068 - protein, 38 aa, Artificial Sequence
  Description of Artificial Sequence: Synthetic polypeptide
DEMEIATTNPVAYEQYGCVCSTWGEDHNEEHFISETQA

SEQ ID NO: 202069 - protein, 36 aa, Artificial Sequence
  Description of Artificial Sequence: Synthetic polypeptide
QEEEIATTNPVAYEQYGEHAPWCEHEFSQHAEGEEV

SEQ ID NO: 202070 - protein, 39 aa, Artificial Sequence
  Description of Artificial Sequence: Synthetic polypeptide
AEEAIRTTNPVATEQYGQCVCSNWGEDHNQEHFNSENQS

SEQ ID NO: 202071 - protein, 35 aa, Artificial Sequence
  Description of Artificial Sequence: Synthetic polypeptide
DETEIRTTNPIATECWGATTWANAEDFAGPKGPYI

SEQ ID NO: 202072 - protein, 35 aa, Artificial Sequence
  Description of Artificial Sequence: Synthetic polypeptide
DETEIRTTNPIATECWGATTWANAEDFAEPKGPYI

SEQ ID NO: 202073 - protein, 35 aa, Artificial Sequence
  Description of Artificial Sequence: Synthetic polypeptide
DETEIRTTNPIATECWGATTWANAEDEANPKGPYI

SEQ ID NO: 202074 - protein, 35 aa, Artificial Sequence
  Description of Artificial Sequence: Synthetic polypeptide
DETEIRTTNPIATECWGATTWANAEDDAEPKGPYI

SEQ ID NO: 202075 - protein, 35 aa, Artificial Sequence
  Description of Artificial Sequence: Synthetic polypeptide
VEDEIATTNPVAYEQWGTNCAATAGEGPDSGPNEH

SEQ ID NO: 202076 - protein, 37 aa, Artificial Sequence
  Description of Artificial Sequence: Synthetic polypeptide
NEDEIACTNPVATEQWGGCNAITNHLTQPDPQMGQDN

SEQ ID NO: 202077 - protein, 34 aa, Artificial Sequence
  Description of Artificial Sequence: Synthetic polypeptide
DETEIRSTNPIATECWGATTWANADWAEPKGPYI

SEQ ID NO: 202078 - protein, 37 aa, Artificial Sequence
  Description of Artificial Sequence: Synthetic polypeptide
DEAVIGTTNPVATEQWGCVCSNSGEDDNQEYFGSDQA

SEQ ID NO: 202079 - protein, 35 aa, Artificial Sequence
  Description of Artificial Sequence: Synthetic polypeptide
DETEIRTTNPIATECWGATTWANAEDWAEFKGYYI

SEQ ID NO: 202080 - protein, 39 aa, Artificial Sequence
  Description of Artificial Sequence: Synthetic polypeptide
DDEEIRTTNPVATEGYGQCVCSNWGEDHNAENFNSETQS

SEQ ID NO: 202081 - protein, 39 aa, Artificial Sequence
  Description of Artificial Sequence: Synthetic polypeptide
DEEEISTTNPVATEGYGQCVCSNWGEDHNAENFISENQA

SEQ ID NO: 202082 - protein, 39 aa, Artificial Sequence
  Description of Artificial Sequence: Synthetic polypeptide
DEEEISTTNPVATEGYGQCVCSNWGEDHNAENFISDNQA

SEQ ID NO: 202083 - protein, 37 aa, Artificial Sequence
  Description of Artificial Sequence: Synthetic polypeptide
VEDEIATTNPVAYEQYGSVCANANNPEGQPDDSEKAN

SEQ ID NO: 202084 - protein, 39 aa, Artificial Sequence
  Description of Artificial Sequence: Synthetic polypeptide
DEEEISTTNPVATEGYGQCVCSNWGEDHNAENFGSETQS

SEQ ID NO: 202085 - protein, 38 aa, Artificial Sequence
  Description of Artificial Sequence: Synthetic polypeptide
DEDEIATTNPVAYEQWGSVCSPANPALPLEHMIDLKAM

SEQ ID NO: 202086 - protein, 39 aa, Artificial Sequence
  Description of Artificial Sequence: Synthetic polypeptide
DEEEISTTNPVATEGYGQCVCSNWGEDHNAENFGSDTQT

SEQ ID NO: 202087 - protein, 35 aa, Artificial Sequence
  Description of Artificial Sequence: Synthetic polypeptide
TSHEIASVNPVCYEPYGVTVISYENLSQSGGNNQA

SEQ ID NO: 202088 - protein, 39 aa, Artificial Sequence
  Description of Artificial Sequence: Synthetic polypeptide
DEEEISTTNPVATEGYGQCVCSNWGEDHNAENFGSDTQS

SEQ ID NO: 202089 - protein, 38 aa, Artificial Sequence
  Description of Artificial Sequence: Synthetic polypeptide
VEDEIACTNPVAYEQYGSACAIANPELGQEHQDGNAHQ

SEQ ID NO: 202090 - protein, 38 aa, Artificial Sequence
  Description of Artificial Sequence: Synthetic polypeptide
QEGEIATTNPVATEQYGCISFSAPDDTLREPHEKEDWR

SEQ ID NO: 202091 - protein, 37 aa, Artificial Sequence
  Description of Artificial Sequence: Synthetic polypeptide
AEEEIACTNPVATEQWGHVVANTGALADAGTHQPESW

SEQ ID NO: 202092 - protein, 35 aa, Artificial Sequence
  Description of Artificial Sequence: Synthetic polypeptide
DETEIRTTNPIATECWGATTWANAEDWAEFKGPYI

SEQ ID NO: 202093 - protein, 36 aa, Artificial Sequence
  Description of Artificial Sequence: Synthetic polypeptide
DENENATTNPCAYECWGCVATPNGNQQNLEGDHQRQ

SEQ ID NO: 202094 - protein, 38 aa, Artificial Sequence
  Description of Artificial Sequence: Synthetic polypeptide
DENEISTTNPVAYEQYGQCVCSWEEEHNAENFNSDNQE

SEQ ID NO: 202095 - protein, 39 aa, Artificial Sequence
  Description of Artificial Sequence: Synthetic polypeptide
DEEEISTTNPVATEGYGQCVCSNWGEDHNAEHFNSDTQA

SEQ ID NO: 202096 - protein, 37 aa, Artificial Sequence
  Description of Artificial Sequence: Synthetic polypeptide
QAEEIATTNPVATEQYGCVAPGEGGHGQNESAEEASQ

SEQ ID NO: 202097 - protein, 35 aa, Artificial Sequence
  Description of Artificial Sequence: Synthetic polypeptide
DETEIRTTNPIATECWGATTWANAEDWAEEKGPYS

SEQ ID NO: 202098 - protein, 39 aa, Artificial Sequence
  Description of Artificial Sequence: Synthetic polypeptide
DEEEISTTNPVATEGYGQCVCSNWGEDHNAEHFNSDNQS

SEQ ID NO: 202099 - protein, 38 aa, Artificial Sequence
  Description of Artificial Sequence: Synthetic polypeptide
DETEIACTNPVATEQYGSACSAANPAEVADAEIGTETA

SEQ ID NO: 202100 - protein, 35 aa, Artificial Sequence
  Description of Artificial Sequence: Synthetic polypeptide
DETEIRTTNPIATECWGATTWANAEDWAEEKGPYI

SEQ ID NO: 202101 - protein, 35 aa, Artificial Sequence
  Description of Artificial Sequence: Synthetic polypeptide
DETEIATTNPIATECWGATVWANAEDWAEHKGEYI

SEQ ID NO: 202102 - protein, 34 aa, Artificial Sequence
  Description of Artificial Sequence: Synthetic polypeptide
DETEIATTNPIATECWGATWSNEEDWAEPKGPYI

SEQ ID NO: 202103 - protein, 39 aa, Artificial Sequence
  Description of Artificial Sequence: Synthetic polypeptide
DEEEISTTNPVATEGYGQCVCSNWGEDHNAENFNSDFQA

SEQ ID NO: 202104 - protein, 39 aa, Artificial Sequence
  Description of Artificial Sequence: Synthetic polypeptide
DEEEISTTNPVATEGYGQCVCSNWGEDHNAENFNSDNQM

SEQ ID NO: 202105 - protein, 35 aa, Artificial Sequence
  Description of Artificial Sequence: Synthetic polypeptide
DETEIRTTNPIATECWGATTWANAEDWAEPCGPYI

SEQ ID NO: 202106 - protein, 39 aa, Artificial Sequence
  Description of Artificial Sequence: Synthetic polypeptide
DEEEISTTNPVATEGYGQCVCSNWGEDHNAENFNSQTQA

SEQ ID NO: 202107 - protein, 39 aa, Artificial Sequence
  Description of Artificial Sequence: Synthetic polypeptide
DEDEIRGTNPVATDQYGVVNDNSIGQNQGGQEDNIDTDW

SEQ ID NO: 202108 - protein, 35 aa, Artificial Sequence
  Description of Artificial Sequence: Synthetic polypeptide
DETEIRTTNPIATECWGATTWANAEDWAEPAGPYI

SEQ ID NO: 202109 - protein, 39 aa, Artificial Sequence
  Description of Artificial Sequence: Synthetic polypeptide
DEEEISTTNPVATEGYGQCVCSNWGEDHNAENFNSETQS

SEQ ID NO: 202110 - protein, 39 aa, Artificial Sequence
  Description of Artificial Sequence: Synthetic polypeptide
DEEEISTTNPVATEGYGQCVCSNWGEDHNAENFNSDTQS

SEQ ID NO: 202111 - protein, 35 aa, Artificial Sequence
  Description of Artificial Sequence: Synthetic polypeptide
DETEIRTTNPIATECWGATTWANAEDWAENKGPYI

SEQ ID NO: 202112 - protein, 35 aa, Artificial Sequence
  Description of Artificial Sequence: Synthetic polypeptide
DETEIRTTNPIATECWGATTWANAEDWAEMKGPYI

SEQ ID NO: 202113 - protein, 35 aa, Artificial Sequence
  Description of Artificial Sequence: Synthetic polypeptide
DETEIRTTNPIATECWGATTWANAEDWAELKGPYI

SEQ ID NO: 202114 - protein, 34 aa, Artificial Sequence
  Description of Artificial Sequence: Synthetic polypeptide
DETEIATTNPIATECWGATTWSNAEDWAEPKGPL

SEQ ID NO: 202115 - protein, 35 aa, Artificial Sequence
  Description of Artificial Sequence: Synthetic polypeptide
DETEIRTTNPIATECWGATTWANAEDWAEKKGPYI

SEQ ID NO: 202116 - protein, 39 aa, Artificial Sequence
  Description of Artificial Sequence: Synthetic polypeptide
DEEEISTTNPVATEGYGQCVCSNWGEDHNAENFNSDTQM

SEQ ID NO: 202117 - protein, 39 aa, Artificial Sequence
  Description of Artificial Sequence: Synthetic polypeptide
DEEEISTTNPVATEGYGQCVCSNWGEDHNAENFNSDTQF

SEQ ID NO: 202118 - protein, 35 aa, Artificial Sequence
  Description of Artificial Sequence: Synthetic polypeptide
DETEIRTTNPIATECWGATTWANAEDWAEKKGPKI

SEQ ID NO: 202119 - protein, 35 aa, Artificial Sequence
  Description of Artificial Sequence: Synthetic polypeptide
DETEIRTTNPIATECWGATTWANAEDWAEIKGPYI

SEQ ID NO: 202120 - protein, 35 aa, Artificial Sequence
  Description of Artificial Sequence: Synthetic polypeptide
DETEIRTTNPIATECWGATTWANAEDWAEHKGPYI

SEQ ID NO: 202121 - protein, 35 aa, Artificial Sequence
  Description of Artificial Sequence: Synthetic polypeptide
DETEIRTTNPIATECWGATTWANAEDWAEHKGPII

SEQ ID NO: 202122 - protein, 35 aa, Artificial Sequence
  Description of Artificial Sequence: Synthetic polypeptide
DETEIRTTNPIATECWGATTWANAEDWAEHKGIYI

SEQ ID NO: 202123 - protein, 39 aa, Artificial Sequence
  Description of Artificial Sequence: Synthetic polypeptide
DEREISTTNPVATEQYGQCVCSNSGEDHNAENFNSDTQS

SEQ ID NO: 202124 - protein, 35 aa, Artificial Sequence
  Description of Artificial Sequence: Synthetic polypeptide
DETEIRTTNPIATECWGATTWANAEDWAEGKGPYI

SEQ ID NO: 202125 - protein, 34 aa, Artificial Sequence
  Description of Artificial Sequence: Synthetic polypeptide
QEGEIACTNPCSYEQWGITCYCNDQQDQSGDTNR

SEQ ID NO: 202126 - protein, 39 aa, Artificial Sequence
  Description of Artificial Sequence: Synthetic polypeptide
DEEEISTTNPVATEGYGQCVCSNWGEDHNAENFNSDTQA

SEQ ID NO: 202127 - protein, 35 aa, Artificial Sequence
  Description of Artificial Sequence: Synthetic polypeptide
DETEIRTTNPIATECWGATTWANAEDWAEGKGFYI

SEQ ID NO: 202128 - protein, 33 aa, Artificial Sequence
  Description of Artificial Sequence: Synthetic polypeptide
TSSEIASTNPLGTEHYGVIASPELSQSTGGDIS

SEQ ID NO: 202129 - protein, 35 aa, Artificial Sequence
  Description of Artificial Sequence: Synthetic polypeptide
DETEIATTNPIATECWGATYYANEGDQDEKKGKEI

SEQ ID NO: 202130 - protein, 34 aa, Artificial Sequence
  Description of Artificial Sequence: Synthetic polypeptide
TESEIAATNPVGTEGWGVCAPTDNQQNHQGQDGN

SEQ ID NO: 202131 - protein, 38 aa, Artificial Sequence
  Description of Artificial Sequence: Synthetic polypeptide
CENEISTTNPVATEQYGQCVCSNWGEHNAENFGSDTQA

SEQ ID NO: 202132 - protein, 39 aa, Artificial Sequence
  Description of Artificial Sequence: Synthetic polypeptide
MEGEIRTTNPVATEQYGSNCSSPAPAVGPNMVFEENSDC

SEQ ID NO: 202133 - protein, 39 aa, Artificial Sequence
  Description of Artificial Sequence: Synthetic polypeptide
VEEEIRGTNPVATDQYGSVVDDQQDETDGQGLEDEEGAQ

SEQ ID NO: 202134 - protein, 36 aa, Artificial Sequence
  Description of Artificial Sequence: Synthetic polypeptide
VEDEIATTNPVAYEQWGTIACAATAGELPDSGENGH

SEQ ID NO: 202135 - protein, 37 aa, Artificial Sequence
  Description of Artificial Sequence: Synthetic polypeptide
VEDEIATTNPVAYEQYGSVCAAANPAWIDQGDPMESW

SEQ ID NO: 202136 - protein, 33 aa, Artificial Sequence
  Description of Artificial Sequence: Synthetic polypeptide
QESEIACTNPCSYEQWGITCYCNDQQDHGDQFR

SEQ ID NO: 202137 - protein, 35 aa, Artificial Sequence
  Description of Artificial Sequence: Synthetic polypeptide
DETEIRTTNPIATECWGATTWANAEDWAAPKGPYI

SEQ ID NO: 202138 - protein, 35 aa, Artificial Sequence
  Description of Artificial Sequence: Synthetic polypeptide
DETEIRTTNPIATECWGATTWANAEDWAAPKGEYI

SEQ ID NO: 202139 - protein, 39 aa, Artificial Sequence
  Description of Artificial Sequence: Synthetic polypeptide
NEEEIRTTNPVAYEQYGQCSCSNWGEPHNQEYFQSDTQA

SEQ ID NO: 202140 - protein, 37 aa, Artificial Sequence
  Description of Artificial Sequence: Synthetic polypeptide
CESEIATTNPIAFEGYGTTVCSATGEEWSENMNVGND

SEQ ID NO: 202141 - protein, 34 aa, Artificial Sequence
  Description of Artificial Sequence: Synthetic polypeptide
DETEIRHTNPIATECWGATTWANAEDWAEPKGPI

SEQ ID NO: 202142 - protein, 39 aa, Artificial Sequence
  Description of Artificial Sequence: Synthetic polypeptide
CEAEIRTTNPVATEQYGQCVCSNWGEDHNQENFNSDNQA

SEQ ID NO: 202143 - protein, 34 aa, Artificial Sequence
  Description of Artificial Sequence: Synthetic polypeptide
TESEIASTNPVGTEAWGVCAPTDRDQHQGQHQDR

SEQ ID NO: 202144 - protein, 35 aa, Artificial Sequence
  Description of Artificial Sequence: Synthetic polypeptide
DETEIRTTNPIATECWGATTWANAEDVAEPKGPYI

SEQ ID NO: 202145 - protein, 36 aa, Artificial Sequence
  Description of Artificial Sequence: Synthetic polypeptide
DETEIRTTNPIATECWGATTWANAEDTWAERKGPYI

SEQ ID NO: 202146 - protein, 35 aa, Artificial Sequence
  Description of Artificial Sequence: Synthetic polypeptide
DETEIRTTNPIATECWGATTWANAEDTGEPKGPYI

SEQ ID NO: 202147 - protein, 35 aa, Artificial Sequence
  Description of Artificial Sequence: Synthetic polypeptide
DETEIRTTNPIATECWGATTWANAEDTAEPPGPYI

SEQ ID NO: 202148 - protein, 38 aa, Artificial Sequence
  Description of Artificial Sequence: Synthetic polypeptide
DEAEIRTTNPVATEQYGYICVYPIMPGKESFAEEESED

SEQ ID NO: 202149 - protein, 40 aa, Artificial Sequence
  Description of Artificial Sequence: Synthetic polypeptide
CEAEIRTTNPVATEQYGDVVVGQGQEDQTEQDNEGEGNGV

SEQ ID NO: 202150 - protein, 37 aa, Artificial Sequence
  Description of Artificial Sequence: Synthetic polypeptide
QAEEIATTNPVATEQYGCVAPGEGPHGQNESAEEANT

SEQ ID NO: 202151 - protein, 35 aa, Artificial Sequence
  Description of Artificial Sequence: Synthetic polypeptide
DETEIRTTNPIATECWGATTWANAEDTAEPKGPYI

SEQ ID NO: 202152 - protein, 38 aa, Artificial Sequence
  Description of Artificial Sequence: Synthetic polypeptide
DEMEICTTNPVATEQYGCACGCHATDGPTEEFFEGNDI

SEQ ID NO: 202153 - protein, 36 aa, Artificial Sequence
  Description of Artificial Sequence: Synthetic polypeptide
NEDEIACTNPVATEQWGGCLAIANHLQPDPQMGQQN

SEQ ID NO: 202154 - protein, 38 aa, Artificial Sequence
  Description of Artificial Sequence: Synthetic polypeptide
DEEEIACTNPVATEQYGSACAPANPAEGQDHQDDSAAK

SEQ ID NO: 202155 - protein, 36 aa, Artificial Sequence
  Description of Artificial Sequence: Synthetic polypeptide
DENCIATVNPVATECYGNVVCIDHQDQEQRQGDDSN

SEQ ID NO: 202156 - protein, 35 aa, Artificial Sequence
  Description of Artificial Sequence: Synthetic polypeptide
DETEIRTTNPIATECWGATTWANAEDWACPKGPYI

SEQ ID NO: 202157 - protein, 39 aa, Artificial Sequence
  Description of Artificial Sequence: Synthetic polypeptide
CEAEIRTTNPVATEQYGQCVCSNWGEDHNQEYFNSDTQS

SEQ ID NO: 202158 - protein, 38 aa, Artificial Sequence
  Description of Artificial Sequence: Synthetic polypeptide
VEEEIRGTNPVATDQYGAVIDDQQDNTEGQLEDEEGGQ

SEQ ID NO: 202159 - protein, 35 aa, Artificial Sequence
  Description of Artificial Sequence: Synthetic polypeptide
DETEIATTNPIATECWGATYYANEHDQHEQTGKTM

SEQ ID NO: 202160 - protein, 35 aa, Artificial Sequence
  Description of Artificial Sequence: Synthetic polypeptide
DETEIRTTNPIATECWGATTWANAEDWAEDKGPYI

SEQ ID NO: 202161 - protein, 36 aa, Artificial Sequence
  Description of Artificial Sequence: Synthetic polypeptide
DENENATTNPCAYECWGCVATPNGNQQQLEGDHGRE

SEQ ID NO: 202162 - protein, 35 aa, Artificial Sequence
  Description of Artificial Sequence: Synthetic polypeptide
DETEIRTTNPIATECWGATTWANAEDWAECKGPYI

SEQ ID NO: 202163 - protein, 34 aa, Artificial Sequence
  Description of Artificial Sequence: Synthetic polypeptide
DETEIRTTNPIATECWGACTWAAEDWAEPKGPYI

SEQ ID NO: 202164 - protein, 35 aa, Artificial Sequence
  Description of Artificial Sequence: Synthetic polypeptide
DEQEIATTNPIATECWGSTTWSNAEDWAEPEGPYI

SEQ ID NO: 202165 - protein, 37 aa, Artificial Sequence
  Description of Artificial Sequence: Synthetic polypeptide
VEDEIACTNPVAYEQYGSTVCASNDGPQEHQDGAEAK

SEQ ID NO: 202166 - protein, 38 aa, Artificial Sequence
  Description of Artificial Sequence: Synthetic polypeptide
AEEEIACTNPVATEQWGHVVANTGALADAGTHQINDSW

SEQ ID NO: 202167 - protein, 39 aa, Artificial Sequence
  Description of Artificial Sequence: Synthetic polypeptide
DEEEISTTNPVATEAYGCAVCSNWGEDHNAENFNSDNQS

SEQ ID NO: 202168 - protein, 35 aa, Artificial Sequence
  Description of Artificial Sequence: Synthetic polypeptide
DETEIRTTNPIATECWGATTWANAEDWAEAKGPYI

SEQ ID NO: 202169 - protein, 38 aa, Artificial Sequence
  Description of Artificial Sequence: Synthetic polypeptide
DENEISTTNPVAYEQYGQCVCSNWGEHNAENFGSDTQS

SEQ ID NO: 202170 - protein, 35 aa, Artificial Sequence
  Description of Artificial Sequence: Synthetic polypeptide
DETEIRTTNPIATECWGATTWANADYWAEPKGPYI

SEQ ID NO: 202171 - protein, 39 aa, Artificial Sequence
  Description of Artificial Sequence: Synthetic polypeptide
AEEEIRCTNPVATEQYGQCVCSNWGEDDNAEYFGSDTQA

SEQ ID NO: 202172 - protein, 37 aa, Artificial Sequence
  Description of Artificial Sequence: Synthetic polypeptide
DEEEIACTNPVGYAPWGNVVSCTNSEISQSRPTSNGW

SEQ ID NO: 202173 - protein, 37 aa, Artificial Sequence
  Description of Artificial Sequence: Synthetic polypeptide
VEDEIACTNPVAYEQYGSVAACPGEGLATGTNGDSVG

SEQ ID NO: 202174 - protein, 38 aa, Artificial Sequence
  Description of Artificial Sequence: Synthetic polypeptide
QEEEIRTTNPVATEQYGAITDNMGMEDSSEEGGGEQAD

SEQ ID NO: 202175 - protein, 35 aa, Artificial Sequence
  Description of Artificial Sequence: Synthetic polypeptide
DEQEIATTNPIATECWGATTWANAEDLAEPKGPYI

SEQ ID NO: 202176 - protein, 39 aa, Artificial Sequence
  Description of Artificial Sequence: Synthetic polypeptide
AEEEIRCTNPVATEQYGQCVCSNWGEDHNAENFNSDNQP

SEQ ID NO: 202177 - protein, 36 aa, Artificial Sequence
  Description of Artificial Sequence: Synthetic polypeptide
QAEEIATTNPVATEQWGCVAPGEGGHGNESGEEDGM

SEQ ID NO: 202178 - protein, 38 aa, Artificial Sequence
  Description of Artificial Sequence: Synthetic polypeptide
DEEEISTTNPVATEGYGCVCGNWGEDHNAENFISENQS

SEQ ID NO: 202179 - protein, 35 aa, Artificial Sequence
  Description of Artificial Sequence: Synthetic polypeptide
DETEIRTTNPIATECWGATTWANAEDWADPKGPYI

SEQ ID NO: 202180 - protein, 39 aa, Artificial Sequence
  Description of Artificial Sequence: Synthetic polypeptide
CEAEIRTTNPVATEQYGQCVCSNWGEPHNAENFNSDNQS

SEQ ID NO: 202181 - protein, 36 aa, Artificial Sequence
  Description of Artificial Sequence: Synthetic polypeptide
DEMEIRTTNPVATECWGATTWANTEGWVEEFKGPYI

SEQ ID NO: 202182 - protein, 38 aa, Artificial Sequence
  Description of Artificial Sequence: Synthetic polypeptide
DENEISTTNPVAYEQYGQCVCSNSGEHNAENFNSDNQM

SEQ ID NO: 202183 - protein, 35 aa, Artificial Sequence
  Description of Artificial Sequence: Synthetic polypeptide
DETEIRTTNPIATECWGATTWANAEDWADPKGPYL

SEQ ID NO: 202184 - protein, 39 aa, Artificial Sequence
  Description of Artificial Sequence: Synthetic polypeptide
DEEEISTTNPVATEGYGQCVCSNWGEDHNAESFNSDTQS

SEQ ID NO: 202185 - protein, 36 aa, Artificial Sequence
  Description of Artificial Sequence: Synthetic polypeptide
CEAEIRTTNPVATEQYGCYYDFDWDVGGAIDGLQQP

SEQ ID NO: 202186 - protein, 39 aa, Artificial Sequence
  Description of Artificial Sequence: Synthetic polypeptide
DEEEISTTNPVATEGYGQCVCSNWEEDHNAEHFNSDTQG

SEQ ID NO: 202187 - protein, 35 aa, Artificial Sequence
  Description of Artificial Sequence: Synthetic polypeptide
DETEIRTTNPIATECWGATTVANPEDWAEPKGPYI

SEQ ID NO: 202188 - protein, 35 aa, Artificial Sequence
  Description of Artificial Sequence: Synthetic polypeptide
DETEIRTTNPIATECWGATTVANAEDWANPKGPYI

SEQ ID NO: 202189 - protein, 38 aa, Artificial Sequence
  Description of Artificial Sequence: Synthetic polypeptide
DEAEIRTTNPVATEWYGQAWYTYNTDPMMDMEINDYQE

SEQ ID NO: 202190 - protein, 37 aa, Artificial Sequence
  Description of Artificial Sequence: Synthetic polypeptide
DEDEIATTNPVATEQWGCCAGTGDHPTNNHPDDSTNN

SEQ ID NO: 202191 - protein, 35 aa, Artificial Sequence
  Description of Artificial Sequence: Synthetic polypeptide
DETEIRTTNPIATECWGATTVANAEDWAEPKGPYI

SEQ ID NO: 202192 - protein, 35 aa, Artificial Sequence
  Description of Artificial Sequence: Synthetic polypeptide
DETEIRTTNPIATECWGATTVANAEDAAEPTGPYI

SEQ ID NO: 202193 - protein, 38 aa, Artificial Sequence
  Description of Artificial Sequence: Synthetic polypeptide
DEEEISCTNPVAYEQYGCVCSNSGEDHNAEFFNSDTQA

SEQ ID NO: 202194 - protein, 35 aa, Artificial Sequence
  Description of Artificial Sequence: Synthetic polypeptide
TEMAIGTTNPVATEQYGCLCTATDGNPVEFETDKQ

SEQ ID NO: 202195 - protein, 38 aa, Artificial Sequence
  Description of Artificial Sequence: Synthetic polypeptide
AEECIRTTNPVATEEYGCSCSNWGEEHNAENFNSDTQA

SEQ ID NO: 202196 - protein, 38 aa, Artificial Sequence
  Description of Artificial Sequence: Synthetic polypeptide
DEEEISCTNPVAYEQYGCVCSNWEEDHNAENFNSDTQA

SEQ ID NO: 202197 - protein, 39 aa, Artificial Sequence
  Description of Artificial Sequence: Synthetic polypeptide
DEDEIRTTNPCATEAYGVVATTNANANETGTEEGNVTIA

SEQ ID NO: 202198 - protein, 37 aa, Artificial Sequence
  Description of Artificial Sequence: Synthetic polypeptide
DENEISTTNPVAYEQWGCVCSNSGEHNAEYSISDNAS

SEQ ID NO: 202199 - protein, 36 aa, Artificial Sequence
  Description of Artificial Sequence: Synthetic polypeptide
QEEEIATTNPVAYEQYGEHAPWCEHEISQTAEGEWQ

SEQ ID NO: 202200 - protein, 35 aa, Artificial Sequence
  Description of Artificial Sequence: Synthetic polypeptide
DENIIATTNPTAYEQWGATYYNIEIEMNQREMDHR

SEQ ID NO: 202201 - protein, 39 aa, Artificial Sequence
  Description of Artificial Sequence: Synthetic polypeptide
DEDEIRTTNPCATEAYGVVATTNANANLTIGTEEGSTII

SEQ ID NO: 202202 - protein, 36 aa, Artificial Sequence
  Description of Artificial Sequence: Synthetic polypeptide
MENCIRTTNPVATETYGHVTCTETVTTSDSTQEAPQ

SEQ ID NO: 202203 - protein, 35 aa, Artificial Sequence
  Description of Artificial Sequence: Synthetic polypeptide
DETEIRTTNPIATECWGATTVACAEDHTEPTGPYI

SEQ ID NO: 202204 - protein, 37 aa, Artificial Sequence
  Description of Artificial Sequence: Synthetic polypeptide
DDEEIRTTNPCAYEHYGCVCSNWEEDNQENFNSDTQA

SEQ ID NO: 202205 - protein, 35 aa, Artificial Sequence
  Description of Artificial Sequence: Synthetic polypeptide
DEAAIGTTNPVATEQYGCLCTATEGWPVEFETIKQ

SEQ ID NO: 202206 - protein, 36 aa, Artificial Sequence
  Description of Artificial Sequence: Synthetic polypeptide
DETEIRTTNPIATECWGATTTANAEDWAEPKGGPYI

SEQ ID NO: 202207 - protein, 38 aa, Artificial Sequence
  Description of Artificial Sequence: Synthetic polypeptide
QENEIRTTNPVATDQYGMIAVNMGMEDINEEGGNEGDG

SEQ ID NO: 202208 - protein, 38 aa, Artificial Sequence
  Description of Artificial Sequence: Synthetic polypeptide
DETEIRTTNPCATEAYGVVATTNANAEDTNEEEGTIYI

SEQ ID NO: 202209 - protein, 36 aa, Artificial Sequence
  Description of Artificial Sequence: Synthetic polypeptide
DETEIRTTNPIATECWGATTTANAEDHWAEPKGPYI

SEQ ID NO: 202210 - protein, 38 aa, Artificial Sequence
  Description of Artificial Sequence: Synthetic polypeptide
DEEEISTTNPVATEGYGICVCSNWVEDNQENFISDTQA

SEQ ID NO: 202211 - protein, 35 aa, Artificial Sequence
  Description of Artificial Sequence: Synthetic polypeptide
DETEIRTTNPIATECWGATTTACAEDHAEPKGPYI

SEQ ID NO: 202212 - protein, 38 aa, Artificial Sequence
  Description of Artificial Sequence: Synthetic polypeptide
DEEEISCTNPVAYEQYGCVCSMWGEDHNAENFNSDTQS

SEQ ID NO: 202213 - protein, 38 aa, Artificial Sequence
  Description of Artificial Sequence: Synthetic polypeptide
DETEIRTTNPCATEAYGVVATTNANAEDTGTEEGTIYN

SEQ ID NO: 202214 - protein, 34 aa, Artificial Sequence
  Description of Artificial Sequence: Synthetic polypeptide
DETEIRTTNPIATECWGATTWAAEDWAEHKGPYI

SEQ ID NO: 202215 - protein, 38 aa, Artificial Sequence
  Description of Artificial Sequence: Synthetic polypeptide
DEDEIRSTNPVATESYGMVSVEQGMGGGQGQEGEEEQT

SEQ ID NO: 202216 - protein, 34 aa, Artificial Sequence
  Description of Artificial Sequence: Synthetic polypeptide
DETEIRTTNPIATECWGATTWAAEDCAEPKGPYI

SEQ ID NO: 202217 - protein, 40 aa, Artificial Sequence
  Description of Artificial Sequence: Synthetic polypeptide
CEAEIRTTNPVATEAYGSVVVGNGQTDQEEQDGEGEGNGV

SEQ ID NO: 202218 - protein, 34 aa, Artificial Sequence
  Description of Artificial Sequence: Synthetic polypeptide
DETEIRTTNPIATECWGATTWAAAEDWAEPKGPD

SEQ ID NO: 202219 - protein, 40 aa, Artificial Sequence
  Description of Artificial Sequence: Synthetic polypeptide
NETEEEIRATNPVAYEQWGCIMEPYGNVSHNDSQRGTTQM

SEQ ID NO: 202220 - protein, 37 aa, Artificial Sequence
  Description of Artificial Sequence: Synthetic polypeptide
AEECIRTTNPVATEIYGCVCGNWGEDNAEYFNSDTQS

SEQ ID NO: 202221 - protein, 39 aa, Artificial Sequence
  Description of Artificial Sequence: Synthetic polypeptide
DEDEIRTTNPCATEAYGVVATTNANALETATEEGTTGIN

SEQ ID NO: 202222 - protein, 39 aa, Artificial Sequence
  Description of Artificial Sequence: Synthetic polypeptide
DEDEIRTTNPCATEAYGVVATTNANALETATEEGTVVIP

SEQ ID NO: 202223 - protein, 38 aa, Artificial Sequence
  Description of Artificial Sequence: Synthetic polypeptide
DEHEIRTTNPVAYEPWGEVYCIETQDDQNQRTLNEGIE

SEQ ID NO: 202224 - protein, 39 aa, Artificial Sequence
  Description of Artificial Sequence: Synthetic polypeptide
DEEEISTTNPVATCQYGQCVCSNWEEDHNAENFISDNQS

SEQ ID NO: 202225 - protein, 38 aa, Artificial Sequence
  Description of Artificial Sequence: Synthetic polypeptide
DEMEIRTTNPVATEGWGQCVCSNWGEDNQEYFGSDTQA

SEQ ID NO: 202226 - protein, 39 aa, Artificial Sequence
  Description of Artificial Sequence: Synthetic polypeptide
DEDEIRTTNPCATEAYGVVATTNANANDTIGTEEGSNIS

SEQ ID NO: 202227 - protein, 39 aa, Artificial Sequence
  Description of Artificial Sequence: Synthetic polypeptide
DEAEIRTTNPVATEWYGQAWYTYNTDPGMNLEINDDYQE

SEQ ID NO: 202228 - protein, 35 aa, Artificial Sequence
  Description of Artificial Sequence: Synthetic polypeptide
DEMEIRTTNPIATECWGAITWANAEDWAEPKGPYI

SEQ ID NO: 202229 - protein, 38 aa, Artificial Sequence
  Description of Artificial Sequence: Synthetic polypeptide
AEECIRTTNPVATEEYGQCSCSNWGEHNAEYFNSDTQA

SEQ ID NO: 202230 - protein, 38 aa, Artificial Sequence
  Description of Artificial Sequence: Synthetic polypeptide
CEEEIACTNPVATEQYGSACGAGGGHQDQDAGGDNEDD

SEQ ID NO: 202231 - protein, 39 aa, Artificial Sequence
  Description of Artificial Sequence: Synthetic polypeptide
DEEEISTTNPVATEGYGQCAVCSNWGEHNTENFNSDTQS

SEQ ID NO: 202232 - protein, 39 aa, Artificial Sequence
  Description of Artificial Sequence: Synthetic polypeptide
CEAEIRSTNPVATEQYGVVVGNGQEDQEEQDGEGEGNGV

SEQ ID NO: 202233 - protein, 39 aa, Artificial Sequence
  Description of Artificial Sequence: Synthetic polypeptide
DENEISTTNPVATEQYGQCVCSNWGELHNAENFNSDTQS

SEQ ID NO: 202234 - protein, 38 aa, Artificial Sequence
  Description of Artificial Sequence: Synthetic polypeptide
MEEEIRTTNPVATEWYGMVSVEEGMGDGGQGQEQDEGV

SEQ ID NO: 202235 - protein, 39 aa, Artificial Sequence
  Description of Artificial Sequence: Synthetic polypeptide
DEEEISTTNPVATEGYGQCAVCSNSGEHNAENFPSENQA

SEQ ID NO: 202236 - protein, 35 aa, Artificial Sequence
  Description of Artificial Sequence: Synthetic polypeptide
DETEIRTTNPIATECWGATTVAWAEDWAEPKGPYI

SEQ ID NO: 202237 - protein, 38 aa, Artificial Sequence
  Description of Artificial Sequence: Synthetic polypeptide
DETEIRTTNPCATEAYGVVATTNANAEDTIGTEEGIGI

SEQ ID NO: 202238 - protein, 34 aa, Artificial Sequence
  Description of Artificial Sequence: Synthetic polypeptide
DETEIRTTNPIATECWGATTWAAEDWAEHKGPYK

SEQ ID NO: 202239 - protein, 37 aa, Artificial Sequence
  Description of Artificial Sequence: Synthetic polypeptide
QAEEIATTNPVATEQYGCVAAGEGGHGQNESAEEANG

SEQ ID NO: 202240 - protein, 36 aa, Artificial Sequence
  Description of Artificial Sequence: Synthetic polypeptide
QEEEIATTNPVAYEQYGEHAPWCEQHEFSQKAEGEW

SEQ ID NO: 202241 - protein, 37 aa, Artificial Sequence
  Description of Artificial Sequence: Synthetic polypeptide
DEDEIATTNPVATEQWGGCTAGNNTLPTATDDSENQD

SEQ ID NO: 202242 - protein, 37 aa, Artificial Sequence
  Description of Artificial Sequence: Synthetic polypeptide
DEDEIATTNPVATEQWGGCTAGNNAALTADDSPENQD

SEQ ID NO: 202243 - protein, 38 aa, Artificial Sequence
  Description of Artificial Sequence: Synthetic polypeptide
DEEEISCTNPVAYEQYGQCVCSNWGEHNAENFNSETQP

SEQ ID NO: 202244 - protein, 38 aa, Artificial Sequence
  Description of Artificial Sequence: Synthetic polypeptide
DEEEISCTNPVAYEQYGQCVCSNWGEHNQENFNSDTQS

SEQ ID NO: 202245 - protein, 36 aa, Artificial Sequence
  Description of Artificial Sequence: Synthetic polypeptide
VEDEIATTNPVATEQWGCNAGNEHALEATMDIDSRM

SEQ ID NO: 202246 - protein, 38 aa, Artificial Sequence
  Description of Artificial Sequence: Synthetic polypeptide
VEGEIRTTNCVATEQYGAVVGLQGDGNGNDLEDENEQY

SEQ ID NO: 202247 - protein, 38 aa, Artificial Sequence
  Description of Artificial Sequence: Synthetic polypeptide
DETEAEIATTNPVAYEQWGTVCVMWDHDNQGHDQGNNG

SEQ ID NO: 202248 - protein, 37 aa, Artificial Sequence
  Description of Artificial Sequence: Synthetic polypeptide
DETEIACTNPVATEQWGSVVAIENGTEATPDIMENGH

SEQ ID NO: 202249 - protein, 38 aa, Artificial Sequence
  Description of Artificial Sequence: Synthetic polypeptide
DETEIRTTNPCATEAYGVVATTNANANDETGTEEGATE

SEQ ID NO: 202250 - protein, 39 aa, Artificial Sequence
  Description of Artificial Sequence: Synthetic polypeptide
DETEIRTTNPCATEAYGVVATTNANANDETGTEEGSNIL

SEQ ID NO: 202251 - protein, 35 aa, Artificial Sequence
  Description of Artificial Sequence: Synthetic polypeptide
DETEIRTTNPIATECWGATTRANAEDWAETKGPYI

SEQ ID NO: 202252 - protein, 35 aa, Artificial Sequence
  Description of Artificial Sequence: Synthetic polypeptide
DETEIRTTNPIATECWGATTRANAEDWAEPKGPYI

SEQ ID NO: 202253 - protein, 34 aa, Artificial Sequence
  Description of Artificial Sequence: Synthetic polypeptide
DESEVRTTNPISTECWGNTWANNETIAEPKGPYR

SEQ ID NO: 202254 - protein, 37 aa, Artificial Sequence
  Description of Artificial Sequence: Synthetic polypeptide
DEAVIGTTNPVATEQWGCVCSWMEDHNQEYFNSDNQA

SEQ ID NO: 202255 - protein, 38 aa, Artificial Sequence
  Description of Artificial Sequence: Synthetic polypeptide
MGENEIRTTNPVATEQYGSCYFPLNSDSDIIDLNNEMQ

SEQ ID NO: 202256 - protein, 38 aa, Artificial Sequence
  Description of Artificial Sequence: Synthetic polypeptide
DEEEISCTNPVAYEQYGQCVCSWMEDHNAEYFNSQTQA

SEQ ID NO: 202257 - protein, 36 aa, Artificial Sequence
  Description of Artificial Sequence: Synthetic polypeptide
AEECIATTNPVATEQYGCYCGWGEDNQEHFNSETQA

SEQ ID NO: 202258 - protein, 38 aa, Artificial Sequence
  Description of Artificial Sequence: Synthetic polypeptide
DETEIRTTNPCATEAYGVVATTNANANDETGTESGSTI

SEQ ID NO: 202259 - protein, 37 aa, Artificial Sequence
  Description of Artificial Sequence: Synthetic polypeptide
DEMEICTTNPVATEQYGCACGCHATDGPTVEFEGFDN

SEQ ID NO: 202260 - protein, 36 aa, Artificial Sequence
  Description of Artificial Sequence: Synthetic polypeptide
DENEIRTTNPVSYEPWGKISCMEDSISDQQNSGEFI

SEQ ID NO: 202261 - protein, 38 aa, Artificial Sequence
  Description of Artificial Sequence: Synthetic polypeptide
MEEEISTTNPVATEFYGVVNMQGINNIDNQTGEFTEEG

SEQ ID NO: 202262 - protein, 37 aa, Artificial Sequence
  Description of Artificial Sequence: Synthetic polypeptide
DEEEIACTNPVATAQWGHSACAAGPLDNTANPGNDLE

SEQ ID NO: 202263 - protein, 38 aa, Artificial Sequence
  Description of Artificial Sequence: Synthetic polypeptide
DEQEIACTNPVATEQYGSCPAIGNGVSEPPDDQSHQDM

SEQ ID NO: 202264 - protein, 38 aa, Artificial Sequence
  Description of Artificial Sequence: Synthetic polypeptide
DEEEISCTNPVAYEQYGQCVCSNWGEHNAENFNSDTQL

SEQ ID NO: 202265 - protein, 37 aa, Artificial Sequence
  Description of Artificial Sequence: Synthetic polypeptide
AEEEIATTNPVATEQYGCYCPMWGEDNAEHFNSETQA

SEQ ID NO: 202266 - protein, 38 aa, Artificial Sequence
  Description of Artificial Sequence: Synthetic polypeptide
DEEEISCTNPVAYEQYGQCVCSNWGEHNAENFNSDNQM

SEQ ID NO: 202267 - protein, 39 aa, Artificial Sequence
  Description of Artificial Sequence: Synthetic polypeptide
DETEIRTTNPCATEAYGVVATTNANALDETATEEGTIYI

SEQ ID NO: 202268 - protein, 39 aa, Artificial Sequence
  Description of Artificial Sequence: Synthetic polypeptide
MEEEIRTTNPVAYEQYGQCVCSNWGEDHNAENFNSDNQS

SEQ ID NO: 202269 - protein, 33 aa, Artificial Sequence
  Description of Artificial Sequence: Synthetic polypeptide
QEPEIACTNPCSYEQWGITCYCNDQQDEGDTVR

SEQ ID NO: 202270 - protein, 38 aa, Artificial Sequence
  Description of Artificial Sequence: Synthetic polypeptide
DAEEIATTNPVATEQWGHTVASAGGNPGENNPGVPDLH

SEQ ID NO: 202271 - protein, 38 aa, Artificial Sequence
  Description of Artificial Sequence: Synthetic polypeptide
NEEEISTTNPVATEGYGQCVCSNWGEHNAEFFNSDTQS

SEQ ID NO: 202272 - protein, 37 aa, Artificial Sequence
  Description of Artificial Sequence: Synthetic polypeptide
TEEPIRCTNPVAYEEYGVSVVACTNAWSTYKPTSQRS

SEQ ID NO: 202273 - protein, 35 aa, Artificial Sequence
  Description of Artificial Sequence: Synthetic polypeptide
DEHEIATTNPVAYECWGTVYWINENMDRQMKHVGS

SEQ ID NO: 202274 - protein, 36 aa, Artificial Sequence
  Description of Artificial Sequence: Synthetic polypeptide
DETEIRTTNPIATECWGATTSANAEDWEAEPKGPYI

SEQ ID NO: 202275 - protein, 35 aa, Artificial Sequence
  Description of Artificial Sequence: Synthetic polypeptide
NEGEVISTTNPVAYECWGITVCTEEGSQSTSNNGM

SEQ ID NO: 202276 - protein, 35 aa, Artificial Sequence
  Description of Artificial Sequence: Synthetic polypeptide
DETEIRTTNPIATECWGATTSACAEDWAEPKGPYI

SEQ ID NO: 202277 - protein, 38 aa, Artificial Sequence
  Description of Artificial Sequence: Synthetic polypeptide
VEDEIATTNPVATEPYGSVVAANMGGLPASDNNGEEGH

SEQ ID NO: 202278 - protein, 38 aa, Artificial Sequence
  Description of Artificial Sequence: Synthetic polypeptide
DENEISTTNPVATEYYGQCVCSNWGEHNAENFNSDTQL

SEQ ID NO: 202279 - protein, 38 aa, Artificial Sequence
  Description of Artificial Sequence: Synthetic polypeptide
DEEEISCTNPVAYEQYGQCVCSNWEEHNAENFNSDTQA

SEQ ID NO: 202280 - protein, 39 aa, Artificial Sequence
  Description of Artificial Sequence: Synthetic polypeptide
DEAEIRTTNPVATEQYGTYIYEGYENPDSSMVATEPQRF

SEQ ID NO: 202281 - protein, 37 aa, Artificial Sequence
  Description of Artificial Sequence: Synthetic polypeptide
DEDEIATTNPVATEQWGCCAGTGAHPGNNHPDDSANN

SEQ ID NO: 202282 - protein, 38 aa, Artificial Sequence
  Description of Artificial Sequence: Synthetic polypeptide
CEAEISTTNPVATEQYGQCVCSNWGEDNQENFNSDTQS

SEQ ID NO: 202283 - protein, 37 aa, Artificial Sequence
  Description of Artificial Sequence: Synthetic polypeptide
CEREISTTNPVATEQYGCVCSNWGEHNAENFISETQT

SEQ ID NO: 202284 - protein, 36 aa, Artificial Sequence
  Description of Artificial Sequence: Synthetic polypeptide
DEDEIATTNPVATEQWGCCAGMGMHPGDNHPDDSHN

SEQ ID NO: 202285 - protein, 38 aa, Artificial Sequence
  Description of Artificial Sequence: Synthetic polypeptide
DEDEIRTTNPCATEAYGVVATTNANNNETGTEEGTTIN

SEQ ID NO: 202286 - protein, 37 aa, Artificial Sequence
  Description of Artificial Sequence: Synthetic polypeptide
TESEIATTNPCASEGYGTVCSATGEEWSENMNVGNYD

SEQ ID NO: 202287 - protein, 37 aa, Artificial Sequence
  Description of Artificial Sequence: Synthetic polypeptide
QAEEIATTNPVATAQYGCVAAGEGGHGQASAEDGNKA

SEQ ID NO: 202288 - protein, 34 aa, Artificial Sequence
  Description of Artificial Sequence: Synthetic polypeptide
DESEVRTTNPISTECWGNTWANNETIAEPKGQYR

SEQ ID NO: 202289 - protein, 37 aa, Artificial Sequence
  Description of Artificial Sequence: Synthetic polypeptide
AEEEIASVNPVCTEQYGCVCSNWGNDHNQESFGSDQA

SEQ ID NO: 202290 - protein, 34 aa, Artificial Sequence
  Description of Artificial Sequence: Synthetic polypeptide
TEHPICSTNPVAYEAWGITVVPTHPHQTRSDNNP

SEQ ID NO: 202291 - protein, 40 aa, Artificial Sequence
  Description of Artificial Sequence: Synthetic polypeptide
DETEIRTTNPCATEAYGVVATTNANALQQSATEEGSVYIS

SEQ ID NO: 202292 - protein, 39 aa, Artificial Sequence
  Description of Artificial Sequence: Synthetic polypeptide
DEEEISTTNPVATEGYGQCQVCSDWEEHNQENFNSETQS

SEQ ID NO: 202293 - protein, 35 aa, Artificial Sequence
  Description of Artificial Sequence: Synthetic polypeptide
VEDEIATTNPVATASWGHCVAAANNEDTDNGGENA

SEQ ID NO: 202294 - protein, 36 aa, Artificial Sequence
  Description of Artificial Sequence: Synthetic polypeptide
AEEEIATTNPVATEQYGCYCPWGEGDNAHFNSETQA

SEQ ID NO: 202295 - protein, 35 aa, Artificial Sequence
  Description of Artificial Sequence: Synthetic polypeptide
DETEIRTTNPIATECWGATTWANAADWAEPLGPYK

SEQ ID NO: 202296 - protein, 35 aa, Artificial Sequence
  Description of Artificial Sequence: Synthetic polypeptide
DETEIRTTNPIATECWGATTWANAADWAEPKGPYI

SEQ ID NO: 202297 - protein, 35 aa, Artificial Sequence
  Description of Artificial Sequence: Synthetic polypeptide
DETEIRTTNPIATECWGATTWANAADWAEPKGPGI

SEQ ID NO: 202298 - protein, 36 aa, Artificial Sequence
  Description of Artificial Sequence: Synthetic polypeptide
DETEIRTTNPIATECWGATTWANAADWAEPKGNPYN

SEQ ID NO: 202299 - protein, 37 aa, Artificial Sequence
  Description of Artificial Sequence: Synthetic polypeptide
NEEEIRTTNPVAATWTHGEMVMELATEVMLEGWGEEV

SEQ ID NO: 202300 - protein, 33 aa, Artificial Sequence
  Description of Artificial Sequence: Synthetic polypeptide
DETEIATTNPIATECYGATWAAEDWAEPKEPYL

SEQ ID NO: 202301 - protein, 36 aa, Artificial Sequence
  Description of Artificial Sequence: Synthetic polypeptide
AETNEIACTNPVAYEQWGCVWSEGNPGDVVNRGDSD

SEQ ID NO: 202302 - protein, 35 aa, Artificial Sequence
  Description of Artificial Sequence: Synthetic polypeptide
DETEIRTTNPIATECWGATTWAMAEDWNEPKGPYI

SEQ ID NO: 202303 - protein, 34 aa, Artificial Sequence
  Description of Artificial Sequence: Synthetic polypeptide
DETEIATTNPIATECYGATWANAEDWAEPKEPYL

SEQ ID NO: 202304 - protein, 35 aa, Artificial Sequence
  Description of Artificial Sequence: Synthetic polypeptide
DETEIRTTNPIATECWGATTWALAEDWAKPKGPYI

SEQ ID NO: 202305 - protein, 35 aa, Artificial Sequence
  Description of Artificial Sequence: Synthetic polypeptide
DETEIRTTNPIATECWGATTWALAEDWAEPKGPYI

SEQ ID NO: 202306 - protein, 33 aa, Artificial Sequence
  Description of Artificial Sequence: Synthetic polypeptide
TESEIASTNPVGTEGWGVCAPTDRDQHNGDDDA

SEQ ID NO: 202307 - protein, 37 aa, Artificial Sequence
  Description of Artificial Sequence: Synthetic polypeptide
DEDEIACTNPVATEQYGSACAANPAEGQDHQDDSDAK

SEQ ID NO: 202308 - protein, 38 aa, Artificial Sequence
  Description of Artificial Sequence: Synthetic polypeptide
DEEEISTTNPVATEGYGQCVCGNWGEHNAENFNSDTQA

SEQ ID NO: 202309 - protein, 35 aa, Artificial Sequence
  Description of Artificial Sequence: Synthetic polypeptide
DETEIRTTNPIATECWGATTWAIATDWAEPAGPYP

SEQ ID NO: 202310 - protein, 35 aa, Artificial Sequence
  Description of Artificial Sequence: Synthetic polypeptide
DEHEIACTNPVAYECWGTVYWINENQDRQMIHVGS

SEQ ID NO: 202311 - protein, 33 aa, Artificial Sequence
  Description of Artificial Sequence: Synthetic polypeptide
TESEIASTNPVGTEGWGVCAPTDRDQHQGDAQG

SEQ ID NO: 202312 - protein, 35 aa, Artificial Sequence
  Description of Artificial Sequence: Synthetic polypeptide
DETEIRTTNPIATECWGATTWAIAEDQAEPEGPYI

SEQ ID NO: 202313 - protein, 33 aa, Artificial Sequence
  Description of Artificial Sequence: Synthetic polypeptide
TESEIASTNPVGTEGWGVCAPTDRDQHQGDHVN

SEQ ID NO: 202314 - protein, 35 aa, Artificial Sequence
  Description of Artificial Sequence: Synthetic polypeptide
DETEIRTTNPIATECWGATTWAHALDWAEPKGPYI

SEQ ID NO: 202315 - protein, 33 aa, Artificial Sequence
  Description of Artificial Sequence: Synthetic polypeptide
TESEIASTNPVGTEGWGVCAPTDRDQHQGQDGV

SEQ ID NO: 202316 - protein, 38 aa, Artificial Sequence
  Description of Artificial Sequence: Synthetic polypeptide
DEAVIGTTNPVATEQWGCVCSNSGEDDNAEYFGSDNQS

SEQ ID NO: 202317 - protein, 38 aa, Artificial Sequence
  Description of Artificial Sequence: Synthetic polypeptide
DEEEISTTNPVATEGYGQCVCGNWGEDHNANFNSETQS

SEQ ID NO: 202318 - protein, 38 aa, Artificial Sequence
  Description of Artificial Sequence: Synthetic polypeptide
DEEEISTTNPVATEGYGQCVCGNWGEHNAENFNSETQN

SEQ ID NO: 202319 - protein, 37 aa, Artificial Sequence
  Description of Artificial Sequence: Synthetic polypeptide
DEEEIACTNPVATEQWGCIITAATPNVDAPMNPNGTE

SEQ ID NO: 202320 - protein, 38 aa, Artificial Sequence
  Description of Artificial Sequence: Synthetic polypeptide
DEDEIATTNPVATEQYGSACAATAGVGGEEHQDDQAAG

SEQ ID NO: 202321 - protein, 39 aa, Artificial Sequence
  Description of Artificial Sequence: Synthetic polypeptide
DEEEISTTNPVATEGYGQCVCQNSGELHNAENFNSDNQS

SEQ ID NO: 202322 - protein, 34 aa, Artificial Sequence
  Description of Artificial Sequence: Synthetic polypeptide
DDSEVASTNPVSTEGYGCVCGTWAIQEYFGSQQM

SEQ ID NO: 202323 - protein, 35 aa, Artificial Sequence
  Description of Artificial Sequence: Synthetic polypeptide
DETEIATTNPIATECYGATTWANAEDWAEPKGPYI

SEQ ID NO: 202324 - protein, 39 aa, Artificial Sequence
  Description of Artificial Sequence: Synthetic polypeptide
DEEEISTTNPVATEGYGQCVCSNWEEDHNAEHFNSDTQA

SEQ ID NO: 202325 - protein, 39 aa, Artificial Sequence
  Description of Artificial Sequence: Synthetic polypeptide
DEEEISTTNPVATEGYGQCVCSNWEEDHNAEHFNSDNQA

SEQ ID NO: 202326 - protein, 39 aa, Artificial Sequence
  Description of Artificial Sequence: Synthetic polypeptide
DEEEISTTNPVATEGYGQCVCSNWEEDHNAEGFNSDTQF

SEQ ID NO: 202327 - protein, 34 aa, Artificial Sequence
  Description of Artificial Sequence: Synthetic polypeptide
TESEIASTNPVGTEGWGVCAPTDNQQNHQGQGEE

SEQ ID NO: 202328 - protein, 37 aa, Artificial Sequence
  Description of Artificial Sequence: Synthetic polypeptide
NDEEISTTNPVATEQYGQCVCSWGEDNAENFISDTQS

SEQ ID NO: 202329 - protein, 33 aa, Artificial Sequence
  Description of Artificial Sequence: Synthetic polypeptide
TESEIASTNPVGTEGWGVCAPTDRDQHDGKDQQ

SEQ ID NO: 202330 - protein, 36 aa, Artificial Sequence
  Description of Artificial Sequence: Synthetic polypeptide
VEDEIATTNPVAYEQWGTTACAATAGELPDSASNPR

SEQ ID NO: 202331 - protein, 35 aa, Artificial Sequence
  Description of Artificial Sequence: Synthetic polypeptide
DETEIRTTNPIATECWGATTWANADDWAEPKGPYI

SEQ ID NO: 202332 - protein, 39 aa, Artificial Sequence
  Description of Artificial Sequence: Synthetic polypeptide
DEEEISTTNPVATEGYGQCVCSNSGELHNAENFNSDTQS

SEQ ID NO: 202333 - protein, 38 aa, Artificial Sequence
  Description of Artificial Sequence: Synthetic polypeptide
DEEEIACTNPVATEQWGCNATANGNGDDTGAPDGSTRN

SEQ ID NO: 202334 - protein, 38 aa, Artificial Sequence
  Description of Artificial Sequence: Synthetic polypeptide
AEECISTTNPVATEQYGQCVCSMWGEHNAENFNSDTQS

SEQ ID NO: 202335 - protein, 39 aa, Artificial Sequence
  Description of Artificial Sequence: Synthetic polypeptide
DEEEISTTNPVATEGYGQCVCSNSGEDHNAENFNSDNQA

SEQ ID NO: 202336 - protein, 35 aa, Artificial Sequence
  Description of Artificial Sequence: Synthetic polypeptide
DETEIRTTNPIATECWGATTWANADDWAEFKGPYI

SEQ ID NO: 202337 - protein, 36 aa, Artificial Sequence
  Description of Artificial Sequence: Synthetic polypeptide
VEDEIATTNPVAYEQWGTTACAATAGELPDSGGNGE

SEQ ID NO: 202338 - protein, 39 aa, Artificial Sequence
  Description of Artificial Sequence: Synthetic polypeptide
DEEEISTTNPVATEGYGQCVCSMWMEDHNAENFNSDNQA

SEQ ID NO: 202339 - protein, 39 aa, Artificial Sequence
  Description of Artificial Sequence: Synthetic polypeptide
DEEEISTTNPVATEGYGQCVCSMWGEDHNQEYFNSDNQS

SEQ ID NO: 202340 - protein, 35 aa, Artificial Sequence
  Description of Artificial Sequence: Synthetic polypeptide
DETEIRTTNPIATECWGATTWANACDWAESKGPYI

SEQ ID NO: 202341 - protein, 38 aa, Artificial Sequence
  Description of Artificial Sequence: Synthetic polypeptide
CDEEISTTNPVATEQYGCVCSNWGPDHNEENFISDNQA

SEQ ID NO: 202342 - protein, 35 aa, Artificial Sequence
  Description of Artificial Sequence: Synthetic polypeptide
DETEIRTTNPIATECWGATTWANACDWAEPKGPYI

SEQ ID NO: 202343 - protein, 39 aa, Artificial Sequence
  Description of Artificial Sequence: Synthetic polypeptide
DEEEISTTNPVATEGYGQCVCSMWGEDHNAENFNSDNQA

SEQ ID NO: 202344 - protein, 39 aa, Artificial Sequence
  Description of Artificial Sequence: Synthetic polypeptide
DEEEISTTNPVATEGYGQCVCQNWEEDHNAEGFNSDTQS

SEQ ID NO: 202345 - protein, 33 aa, Artificial Sequence
  Description of Artificial Sequence: Synthetic polypeptide
TESEIASTNPVGTEGWGVCAPTDRDQHGQQPQH

SEQ ID NO: 202346 - protein, 38 aa, Artificial Sequence
  Description of Artificial Sequence: Synthetic polypeptide
DEEEISTTNPVATEGYGCVCQNWGEDHNAENFNSDNQA

SEQ ID NO: 202347 - protein, 34 aa, Artificial Sequence
  Description of Artificial Sequence: Synthetic polypeptide
DETEIRTTNPIATECWGATTWAEEDWAEPKGPYI

SEQ ID NO: 202348 - protein, 38 aa, Artificial Sequence
  Description of Artificial Sequence: Synthetic polypeptide
DETEIACTNPVATEQYGSACNPTPDGLPLGAGEGFHQW

SEQ ID NO: 202349 - protein, 35 aa, Artificial Sequence
  Description of Artificial Sequence: Synthetic polypeptide
AETEIRTTNPIATECWGATAWANAEDWQEPKGPYI

SEQ ID NO: 202350 - protein, 35 aa, Artificial Sequence
  Description of Artificial Sequence: Synthetic polypeptide
DETEIRTTNPIATECWGATTWAAEDWAEPKGPYIR

SEQ ID NO: 202351 - protein, 34 aa, Artificial Sequence
  Description of Artificial Sequence: Synthetic polypeptide
DETEIRTTNPIATECWGATTWAAEDWAEPKGPYI

SEQ ID NO: 202352 - protein, 40 aa, Artificial Sequence
  Description of Artificial Sequence: Synthetic polypeptide
DEEEISTTNPVATEGYGQCQVTSTWGADHNAENFGSDPQA

SEQ ID NO: 202353 - protein, 37 aa, Artificial Sequence
  Description of Artificial Sequence: Synthetic polypeptide
DEEEIATTNPVAYAQYGCTIPNPNVGPYEASINEQTS

SEQ ID NO: 202354 - protein, 39 aa, Artificial Sequence
  Description of Artificial Sequence: Synthetic polypeptide
DEEEISTTNPVATEGYGQCQVCSNWGEHNAENFNSDTQS

SEQ ID NO: 202355 - protein, 34 aa, Artificial Sequence
  Description of Artificial Sequence: Synthetic polypeptide
DETEIATTNPIATEQWGATWPNAEDWAEHKEPYI

SEQ ID NO: 202356 - protein, 34 aa, Artificial Sequence
  Description of Artificial Sequence: Synthetic polypeptide
DETEIATTNPIATEQWGATWPNAEDWAEPKEPYI

SEQ ID NO: 202357 - protein, 40 aa, Artificial Sequence
  Description of Artificial Sequence: Synthetic polypeptide
DEEEISTTNPVATEGYGQCQVCSNWGEDHNTENFNSDNQS

SEQ ID NO: 202358 - protein, 37 aa, Artificial Sequence
  Description of Artificial Sequence: Synthetic polypeptide
DENEISTTNPVATEGYGCVCSNWGEDNQENFSSDTQS

SEQ ID NO: 202359 - protein, 34 aa, Artificial Sequence
  Description of Artificial Sequence: Synthetic polypeptide
DETEIRTTNPIATECWGATTWAAEDWAEPEGPYI

SEQ ID NO: 202360 - protein, 39 aa, Artificial Sequence
  Description of Artificial Sequence: Synthetic polypeptide
DEEEISTTNPVATEGYGQCQVCSNWGEDEQENFNSDNQS

SEQ ID NO: 202361 - protein, 36 aa, Artificial Sequence
  Description of Artificial Sequence: Synthetic polypeptide
DENEIRTTNPVSYEGYGCICSWEEINQEHFGSDTQA

SEQ ID NO: 202362 - protein, 38 aa, Artificial Sequence
  Description of Artificial Sequence: Synthetic polypeptide
DENEISTTNPVATEGYGCVCSNWGEDHNAENFNSDTQA

SEQ ID NO: 202363 - protein, 35 aa, Artificial Sequence
  Description of Artificial Sequence: Synthetic polypeptide
VEDEIATTNPVATASWGCVAAANNEPMDNGGENDG

SEQ ID NO: 202364 - protein, 37 aa, Artificial Sequence
  Description of Artificial Sequence: Synthetic polypeptide
CEDEIACTNPVATEQWGCVNAAGAHTENPSDQTEGDN

SEQ ID NO: 202365 - protein, 39 aa, Artificial Sequence
  Description of Artificial Sequence: Synthetic polypeptide
DEEEISTTNPVATEGYGQCQVCSNSGEHNAENFNSDTQS

SEQ ID NO: 202366 - protein, 36 aa, Artificial Sequence
  Description of Artificial Sequence: Synthetic polypeptide
VEDEIATTNPVATASWGCVAAANNEVPDRGGENTHD

SEQ ID NO: 202367 - protein, 39 aa, Artificial Sequence
  Description of Artificial Sequence: Synthetic polypeptide
DEEEIRTTNPVAYEQYGQCVCSNWEEDHNQENFISDTQA

SEQ ID NO: 202368 - protein, 37 aa, Artificial Sequence
  Description of Artificial Sequence: Synthetic polypeptide
QAEEIATTNPVATEQYGCVAPPGEGGHGPNESAEEAN

SEQ ID NO: 202369 - protein, 37 aa, Artificial Sequence
  Description of Artificial Sequence: Synthetic polypeptide
TEMCISTTNPVATEQYGCVCSNWGEDHNAYFLSDTQS

SEQ ID NO: 202370 - protein, 32 aa, Artificial Sequence
  Description of Artificial Sequence: Synthetic polypeptide
QEGEIACTNPCSYEQWGITCYCNDQQDTMDTR

SEQ ID NO: 202371 - protein, 41 aa, Artificial Sequence
  Description of Artificial Sequence: Synthetic polypeptide
NETEEEIRTTNPVAYEQWGEIAEPYGTVSWNEGTQRGTTQM

SEQ ID NO: 202372 - protein, 38 aa, Artificial Sequence
  Description of Artificial Sequence: Synthetic polypeptide
DEAEIRTTNPVATEWYGQAWYTYNTDGVMDLEINDYQE

SEQ ID NO: 202373 - protein, 34 aa, Artificial Sequence
  Description of Artificial Sequence: Synthetic polypeptide
DETEIRTTNPIATECWGATTWAAEDWAESKGPYI

SEQ ID NO: 202374 - protein, 37 aa, Artificial Sequence
  Description of Artificial Sequence: Synthetic polypeptide
DEDEIRGTNPVATEGYGTVMGADNQNEMTGGADQDEG

SEQ ID NO: 202375 - protein, 34 aa, Artificial Sequence
  Description of Artificial Sequence: Synthetic polypeptide
DETEIATTNPIATEQWGATWANAEDWAEPKEPYI

SEQ ID NO: 202376 - protein, 38 aa, Artificial Sequence
  Description of Artificial Sequence: Synthetic polypeptide
NDEEISTTNPVATEQYGCVCSNWGEDPNQENFGSDTQS

SEQ ID NO: 202377 - protein, 38 aa, Artificial Sequence
  Description of Artificial Sequence: Synthetic polypeptide
DEAEIRTTNPVATEWYGQAWTTYGTDPGMDLEINDYQE

SEQ ID NO: 202378 - protein, 38 aa, Artificial Sequence
  Description of Artificial Sequence: Synthetic polypeptide
NEDEIATTNPVAYEQWGSVSGGEPGNGGNMRRKMEMMP

SEQ ID NO: 202379 - protein, 35 aa, Artificial Sequence
  Description of Artificial Sequence: Synthetic polypeptide
DETEIATTNPIATEGWGATTWANAETWQEPKGPYI

SEQ ID NO: 202380 - protein, 38 aa, Artificial Sequence
  Description of Artificial Sequence: Synthetic polypeptide
DETEIACTNPVATEQYGSACNPNPDGLPLGAMEGFHLW

SEQ ID NO: 202381 - protein, 36 aa, Artificial Sequence
  Description of Artificial Sequence: Synthetic polypeptide
DEDEIATTNPVATEQWGCCAPQGDHPGDNHPDDSNN

SEQ ID NO: 202382 - protein, 35 aa, Artificial Sequence
  Description of Artificial Sequence: Synthetic polypeptide
DETEIRTTNPIATECWGATTWAEAEDTASPKGPYI

SEQ ID NO: 202383 - protein, 38 aa, Artificial Sequence
  Description of Artificial Sequence: Synthetic polypeptide
DETEIACTNPVATEQYGSACGPANDTSPLIDAEEGKAE

SEQ ID NO: 202384 - protein, 38 aa, Artificial Sequence
  Description of Artificial Sequence: Synthetic polypeptide
AEECIRTTNPVATEQWGQCVCGNWNETNAEYFGSQTQS

SEQ ID NO: 202385 - protein, 37 aa, Artificial Sequence
  Description of Artificial Sequence: Synthetic polypeptide
DEHEIRTTNPVAYEPWGEVYCIEHQDDQNQRLNEGIA

SEQ ID NO: 202386 - protein, 39 aa, Artificial Sequence
  Description of Artificial Sequence: Synthetic polypeptide
DEEEISTTNPVATEGYGQCVCGNWGEDHNAENFGSDNQS

SEQ ID NO: 202387 - protein, 36 aa, Artificial Sequence
  Description of Artificial Sequence: Synthetic polypeptide
NEDEIATTNPVAYEPWGHNVATPAHQGADSDGNAPE

SEQ ID NO: 202388 - protein, 36 aa, Artificial Sequence
  Description of Artificial Sequence: Synthetic polypeptide
DEDEIATTNPVATEQWGCCALAGAHPGDLHPDDSNN

SEQ ID NO: 202389 - protein, 39 aa, Artificial Sequence
  Description of Artificial Sequence: Synthetic polypeptide
DEAEIRTTNPVATEWYGQAWYTYNSDPTVQDLEINDYQE

SEQ ID NO: 202390 - protein, 35 aa, Artificial Sequence
  Description of Artificial Sequence: Synthetic polypeptide
AEEAIASVNPVCTEQYGCVCSWGEHNQESFGSDQA

SEQ ID NO: 202391 - protein, 39 aa, Artificial Sequence
  Description of Artificial Sequence: Synthetic polypeptide
DDEEINTTNPVATEFYGCVNVNMTGLQEENDGEFGETTT

SEQ ID NO: 202392 - protein, 38 aa, Artificial Sequence
  Description of Artificial Sequence: Synthetic polypeptide
CDECISTTNPVATEQYGQCVCSNWGEHNAENFGSDNQS

SEQ ID NO: 202393 - protein, 39 aa, Artificial Sequence
  Description of Artificial Sequence: Synthetic polypeptide
DEEEIRTTNPVAYEQYGQCVCSNWMEDDNQENFISDTQA

SEQ ID NO: 202394 - protein, 35 aa, Artificial Sequence
  Description of Artificial Sequence: Synthetic polypeptide
QEEEIRTTNPIATECWGATAWANEEDWQEPKEPYI

SEQ ID NO: 202395 - protein, 34 aa, Artificial Sequence
  Description of Artificial Sequence: Synthetic polypeptide
DETEIRTTNPIATECWGATTWAAIDWAEPEGPYI

SEQ ID NO: 202396 - protein, 34 aa, Artificial Sequence
  Description of Artificial Sequence: Synthetic polypeptide
DETEIRTTNPIATECWGATTWAAEDWMNPKGPYI

SEQ ID NO: 202397 - protein, 34 aa, Artificial Sequence
  Description of Artificial Sequence: Synthetic polypeptide
DETEIRTTNPIATECWGATTWAAEDWMEPKGPYI

SEQ ID NO: 202398 - protein, 39 aa, Artificial Sequence
  Description of Artificial Sequence: Synthetic polypeptide
NEDEIRTTNPVATEFYGQVVINDEFGTQDQIGVGGGNAG

SEQ ID NO: 202399 - protein, 39 aa, Artificial Sequence
  Description of Artificial Sequence: Synthetic polypeptide
DEEEISTTNPVATEGYGQCSCSMWEEDHNAEYFGSDTQS

SEQ ID NO: 202400 - protein, 37 aa, Artificial Sequence
  Description of Artificial Sequence: Synthetic polypeptide
CEMEISTTNPVAYEQYGCVCSNWGEHNAENFNSETQS

SEQ ID NO: 202401 - protein, 34 aa, Artificial Sequence
  Description of Artificial Sequence: Synthetic polypeptide
DETEIRTTNPIATECWGATTWAAADWAEPKGPYI

SEQ ID NO: 202402 - protein, 40 aa, Artificial Sequence
  Description of Artificial Sequence: Synthetic polypeptide
DEEEISTTNPVATEQYGQCQVCSNWGEDHNAEGFNSDTQA

SEQ ID NO: 202403 - protein, 34 aa, Artificial Sequence
  Description of Artificial Sequence: Synthetic polypeptide
TEDEIASVNPVCYEPYGVTVNTINHSTAAGGGNV

SEQ ID NO: 202404 - protein, 39 aa, Artificial Sequence
  Description of Artificial Sequence: Synthetic polypeptide
DENEIRTTNPVATEWYGCAWYTYNTDPGQDLEHNDDYQE

SEQ ID NO: 202405 - protein, 39 aa, Artificial Sequence
  Description of Artificial Sequence: Synthetic polypeptide
AEEEISTTNPVATEGYGQCVCSMWGEDTNAENFNSENQS

SEQ ID NO: 202406 - protein, 37 aa, Artificial Sequence
  Description of Artificial Sequence: Synthetic polypeptide
CETEIACTNPVAYEQYGSACSPANDTLNPDAEEGKME

SEQ ID NO: 202407 - protein, 38 aa, Artificial Sequence
  Description of Artificial Sequence: Synthetic polypeptide
DENEIRTTNPVATEVWGMVVDNGEEGEEMNAGEGDGEL

SEQ ID NO: 202408 - protein, 38 aa, Artificial Sequence
  Description of Artificial Sequence: Synthetic polypeptide
CEEEIATTNPVATEQWGCNVAGNNGGLPEENNHGIDIQ

SEQ ID NO: 202409 - protein, 37 aa, Artificial Sequence
  Description of Artificial Sequence: Synthetic polypeptide
SDEEISTTNPVATCQYGCVCSNWMEHNQENFGSDTQS

SEQ ID NO: 202410 - protein, 38 aa, Artificial Sequence
  Description of Artificial Sequence: Synthetic polypeptide
DEMEIATTNPVATEGYGCVCSNWGEDHNAEHFNSETQG

SEQ ID NO: 202411 - protein, 39 aa, Artificial Sequence
  Description of Artificial Sequence: Synthetic polypeptide
DEEEIRTTNPVATEGYGICVCSNSGEDDNAEYFISDTQA

SEQ ID NO: 202412 - protein, 38 aa, Artificial Sequence
  Description of Artificial Sequence: Synthetic polypeptide
DENEIRTTNPVATEWYGQAWYTYNTDPGQDLEHIDYQE

SEQ ID NO: 202413 - protein, 34 aa, Artificial Sequence
  Description of Artificial Sequence: Synthetic polypeptide
DDSEVATTNPVSTEGWGNTTWANADIAERKGQYR

SEQ ID NO: 202414 - protein, 39 aa, Artificial Sequence
  Description of Artificial Sequence: Synthetic polypeptide
DEACIRTTNPVATEQYGQCVCSNWEEDHNIENFNSDTQA

SEQ ID NO: 202415 - protein, 37 aa, Artificial Sequence
  Description of Artificial Sequence: Synthetic polypeptide
SDEEIRTTNPVAYCQYGCVCSNWMEHNAENFGSDTQS

SEQ ID NO: 202416 - protein, 38 aa, Artificial Sequence
  Description of Artificial Sequence: Synthetic polypeptide
DDECIRCTNPVATEQYGQCVCSNWGEDNAEYFNSDNQS

SEQ ID NO: 202417 - protein, 39 aa, Artificial Sequence
  Description of Artificial Sequence: Synthetic polypeptide
DEACIRTTNPVATEQYGQCVCSNWGEDHNAENFNSDNQS

SEQ ID NO: 202418 - protein, 36 aa, Artificial Sequence
  Description of Artificial Sequence: Synthetic polypeptide
AENCIACTNPVATEQYGQCSCSWGEDNQEYFGSDQA

SEQ ID NO: 202419 - protein, 38 aa, Artificial Sequence
  Description of Artificial Sequence: Synthetic polypeptide
DEAEISTTNPVATEQYGQCVCSNWGEHNQEFFPSDTQS

SEQ ID NO: 202420 - protein, 39 aa, Artificial Sequence
  Description of Artificial Sequence: Synthetic polypeptide
AEEEISTTNPVATEQYGQCVCSNWGPDHNTENFNSDTQF

SEQ ID NO: 202421 - protein, 36 aa, Artificial Sequence
  Description of Artificial Sequence: Synthetic polypeptide
DEMEIRTTNPVAYEGWGCVCSWGEDNAEYFISDTQS

SEQ ID NO: 202422 - protein, 38 aa, Artificial Sequence
  Description of Artificial Sequence: Synthetic polypeptide
CETEIACTNPVATEQYGVSACSAANPAEADAEIGANTA

SEQ ID NO: 202423 - protein, 39 aa, Artificial Sequence
  Description of Artificial Sequence: Synthetic polypeptide
DDAEIRTTNPVATEQYGQCVCSNWGEDHNAENFNSDTQS

SEQ ID NO: 202424 - protein, 39 aa, Artificial Sequence
  Description of Artificial Sequence: Synthetic polypeptide
DENEIRTTNPVATEWYGQAWYTYNTDPSGQDLEHNDIQE

SEQ ID NO: 202425 - protein, 39 aa, Artificial Sequence
  Description of Artificial Sequence: Synthetic polypeptide
DEEEIRTTNPVAYEQFGQCVCSNWMYDHNAENFGSETQS

SEQ ID NO: 202426 - protein, 38 aa, Artificial Sequence
  Description of Artificial Sequence: Synthetic polypeptide
DEEEIATTNPVAYEQYGCTIPNPNEVGPWAASINEQTS

SEQ ID NO: 202427 - protein, 38 aa, Artificial Sequence
  Description of Artificial Sequence: Synthetic polypeptide
DEEEIATTNPVAYEQYGCTIPNPNVFPTQEASINEQTS

SEQ ID NO: 202428 - protein, 38 aa, Artificial Sequence
  Description of Artificial Sequence: Synthetic polypeptide
AEEEISTTNPVATEGYGCVCSNWGEDHNQEAFNSENQS

SEQ ID NO: 202429 - protein, 38 aa, Artificial Sequence
  Description of Artificial Sequence: Synthetic polypeptide
SDEEISTTNPVATEQYGQCVCSWGEDHNAENFNSDNQM

SEQ ID NO: 202430 - protein, 39 aa, Artificial Sequence
  Description of Artificial Sequence: Synthetic polypeptide
DDEEIRTTNPVATEQYGQCVCSDWGEDHNAEHFSSDTQA

SEQ ID NO: 202431 - protein, 39 aa, Artificial Sequence
  Description of Artificial Sequence: Synthetic polypeptide
CEEEIRTTNPVATEQYGQCVCSNWGEDHDIEYFNSDTQS

SEQ ID NO: 202432 - protein, 38 aa, Artificial Sequence
  Description of Artificial Sequence: Synthetic polypeptide
DEECIRTTNPVATEGWGQCVCGNWNEDNQEYSNSDTQS

SEQ ID NO: 202433 - protein, 38 aa, Artificial Sequence
  Description of Artificial Sequence: Synthetic polypeptide
DEEEIATTNPVAYEQYGCTIPNPNVGPMWEASINEQTS

SEQ ID NO: 202434 - protein, 39 aa, Artificial Sequence
  Description of Artificial Sequence: Synthetic polypeptide
DEACIRTTNPVATEQYGQCVCETWGEDPNAEYFNSDTQS

SEQ ID NO: 202435 - protein, 39 aa, Artificial Sequence
  Description of Artificial Sequence: Synthetic polypeptide
AEEEISTTNPVATEGYGQCIVCSNWGEHNTENFNSENQS

SEQ ID NO: 202436 - protein, 39 aa, Artificial Sequence
  Description of Artificial Sequence: Synthetic polypeptide
DEAEISTTNPVATEQYGQCVCSNWGELHNAENFNSDTQS

SEQ ID NO: 202437 - protein, 38 aa, Artificial Sequence
  Description of Artificial Sequence: Synthetic polypeptide
DEEEIATTNPVAYEQYGICTIPNPNVGMWEASINEQTS

SEQ ID NO: 202438 - protein, 38 aa, Artificial Sequence
  Description of Artificial Sequence: Synthetic polypeptide
DEEEIATTNPVAYEQYGICTIPNPNVGPCEASINEQDS

SEQ ID NO: 202439 - protein, 35 aa, Artificial Sequence
  Description of Artificial Sequence: Synthetic polypeptide
AENAIACTNPVATEQYGCSCSWGEDNQYFISDTQS

SEQ ID NO: 202440 - protein, 38 aa, Artificial Sequence
  Description of Artificial Sequence: Synthetic polypeptide
SDEEISTTNPVATEQYGCVCSNWGEDHNAENFNSDTQS

SEQ ID NO: 202441 - protein, 37 aa, Artificial Sequence
  Description of Artificial Sequence: Synthetic polypeptide
SDEEISTTNPVATEQYGCVCGNWGADNAENFISDTQS

SEQ ID NO: 202442 - protein, 38 aa, Artificial Sequence
  Description of Artificial Sequence: Synthetic polypeptide
DEAEISTTNPVAYEQYGQCVCSNWGEHNIENFISDNQS

SEQ ID NO: 202443 - protein, 38 aa, Artificial Sequence
  Description of Artificial Sequence: Synthetic polypeptide
AEEEISTTNPVATEGYGQCVCNNSGEHNAENFNSDNQA

SEQ ID NO: 202444 - protein, 38 aa, Artificial Sequence
  Description of Artificial Sequence: Synthetic polypeptide
DDECIRTTNPVATEGYGQCVCSNWEEHNIENFNSDNQS

SEQ ID NO: 202445 - protein, 38 aa, Artificial Sequence
  Description of Artificial Sequence: Synthetic polypeptide
DEMEIRTTNPVAYEGYGCVTSTWGEDHNAENFISDPQA

SEQ ID NO: 202446 - protein, 38 aa, Artificial Sequence
  Description of Artificial Sequence: Synthetic polypeptide
DEEEIRTTNPVGTEQWGSFVAGQAGEPGGEHGGDIEAM

SEQ ID NO: 202447 - protein, 36 aa, Artificial Sequence
  Description of Artificial Sequence: Synthetic polypeptide
DEAEIACTNPVATEQWGCTTAGNVGELPDNNSEHSN

SEQ ID NO: 202448 - protein, 38 aa, Artificial Sequence
  Description of Artificial Sequence: Synthetic polypeptide
DEMEISTTNPVSTEQYGQCVCGNWGEHNAEGFNSQTQA

SEQ ID NO: 202449 - protein, 34 aa, Artificial Sequence
  Description of Artificial Sequence: Synthetic polypeptide
DEESIACTNPVATASWGCVAGTGENGPDDSPEMD

SEQ ID NO: 202450 - protein, 39 aa, Artificial Sequence
  Description of Artificial Sequence: Synthetic polypeptide
DEECIRCTNPVATEQYGQCVCSNWGEDDNQENFNSDNQS

SEQ ID NO: 202451 - protein, 39 aa, Artificial Sequence
  Description of Artificial Sequence: Synthetic polypeptide
DEAEISTTNPVATEQYGQCVCSNWGEDHNQEYFNSDNQS

SEQ ID NO: 202452 - protein, 38 aa, Artificial Sequence
  Description of Artificial Sequence: Synthetic polypeptide
DEEEIRTTNPCAYCQYGCVCPNWGEDHNQEYFGSDTQA

SEQ ID NO: 202453 - protein, 39 aa, Artificial Sequence
  Description of Artificial Sequence: Synthetic polypeptide
DEMEIRTTNPVAYEQYGQCVCSNWMEDDNIENFNSQTQA

SEQ ID NO: 202454 - protein, 39 aa, Artificial Sequence
  Description of Artificial Sequence: Synthetic polypeptide
DEAEISTTNPVATEQYGQCVCSNWGEDHNQENFNSETQS

SEQ ID NO: 202455 - protein, 39 aa, Artificial Sequence
  Description of Artificial Sequence: Synthetic polypeptide
DEMEIRTTNPVAYEQYGQCVCSNWMEDHNAEYFNSQTQS

SEQ ID NO: 202456 - protein, 39 aa, Artificial Sequence
  Description of Artificial Sequence: Synthetic polypeptide
DEAEISTTNPVATEQYGQCVCSNWGEDHNQEYFNSDTQG

SEQ ID NO: 202457 - protein, 36 aa, Artificial Sequence
  Description of Artificial Sequence: Synthetic polypeptide
CETEIACTNPVATEQYGSVCAGFDIHPDNNNSEEAM

SEQ ID NO: 202458 - protein, 38 aa, Artificial Sequence
  Description of Artificial Sequence: Synthetic polypeptide
DDEAISTTNPVATEQYGQCVCSNWGEHNQESFGSDTQS

SEQ ID NO: 202459 - protein, 36 aa, Artificial Sequence
  Description of Artificial Sequence: Synthetic polypeptide
DESEIRTTNPIATECWGGATTPANATDWIEPKGPYP

SEQ ID NO: 202460 - protein, 38 aa, Artificial Sequence
  Description of Artificial Sequence: Synthetic polypeptide
AEEEISTTNPVATEGYGQCVCSNWGEHNAEFFNSDTQS

SEQ ID NO: 202461 - protein, 38 aa, Artificial Sequence
  Description of Artificial Sequence: Synthetic polypeptide
DEMEISTTNPVGTEQYGCVCSNSGEDHNAENFGSDTQA

SEQ ID NO: 202462 - protein, 34 aa, Artificial Sequence
  Description of Artificial Sequence: Synthetic polypeptide
DDSEIASTNPVSTEGWGNTVWAAADIAERVGQYR

SEQ ID NO: 202463 - protein, 36 aa, Artificial Sequence
  Description of Artificial Sequence: Synthetic polypeptide
DESEIRTTNPIATECWGCTTWANAEDGQEPKGPYIN

SEQ ID NO: 202464 - protein, 38 aa, Artificial Sequence
  Description of Artificial Sequence: Synthetic polypeptide
DEMEISCTNPVATEQYGCVCSMWGEDDNAEGFNSQTQA

SEQ ID NO: 202465 - protein, 33 aa, Artificial Sequence
  Description of Artificial Sequence: Synthetic polypeptide
QETEIACTNPCSYEQWGITCYCNDQQDQGDTGR

SEQ ID NO: 202466 - protein, 39 aa, Artificial Sequence
  Description of Artificial Sequence: Synthetic polypeptide
AEEEISTTNPVATEGYGQCVCSNWGEDTNAENFNSDTQS

SEQ ID NO: 202467 - protein, 37 aa, Artificial Sequence
  Description of Artificial Sequence: Synthetic polypeptide
AENEIACTNPVATEQYGICSCSWGEDNQEYFNSDNQS

SEQ ID NO: 202468 - protein, 34 aa, Artificial Sequence
  Description of Artificial Sequence: Synthetic polypeptide
DEESIACTNPVATASWGCVAGTGENGPDDSPFMD

SEQ ID NO: 202469 - protein, 39 aa, Artificial Sequence
  Description of Artificial Sequence: Synthetic polypeptide
DDEEIRTTNPVATEQYGQCVCSNWGEDHNQENFISDTQS

SEQ ID NO: 202470 - protein, 35 aa, Artificial Sequence
  Description of Artificial Sequence: Synthetic polypeptide
QEDEIATTNPVAYEQYGEHAWCEQHEFSQHAEGEL

SEQ ID NO: 202471 - protein, 39 aa, Artificial Sequence
  Description of Artificial Sequence: Synthetic polypeptide
SDEEIRTTNPVATEQYGQCVCSNWGEDHNAENFNSDTQP

SEQ ID NO: 202472 - protein, 37 aa, Artificial Sequence
  Description of Artificial Sequence: Synthetic polypeptide
DEMCISTTNPVATEGYGCVCSNWGEPNAESFNSDTQA

SEQ ID NO: 202473 - protein, 36 aa, Artificial Sequence
  Description of Artificial Sequence: Synthetic polypeptide
DEEEIRTTNPCAYEPPWGSPFAASDHVGMGGDIEAM

SEQ ID NO: 202474 - protein, 38 aa, Artificial Sequence
  Description of Artificial Sequence: Synthetic polypeptide
SDEEIRTTNPVATEQWGQCVCSNWGEHNAEYFNSDNQA

SEQ ID NO: 202475 - protein, 37 aa, Artificial Sequence
  Description of Artificial Sequence: Synthetic polypeptide
DEECISTTNPVATEGYGCVCNNWGEAHNQYFISDTQS

SEQ ID NO: 202476 - protein, 40 aa, Artificial Sequence
  Description of Artificial Sequence: Synthetic polypeptide
DENEIRTTNPVATEGYGQASCMCVAGVELLQEFVVQEDRN

SEQ ID NO: 202477 - protein, 38 aa, Artificial Sequence
  Description of Artificial Sequence: Synthetic polypeptide
SDEEIRTTNPVATEQWGCVCSNWGEDHNQENFGSDTQA

SEQ ID NO: 202478 - protein, 38 aa, Artificial Sequence
  Description of Artificial Sequence: Synthetic polypeptide
CEEEISTTNPVATEQYGQCVCSWGEDHNAENFFSDTQA

SEQ ID NO: 202479 - protein, 37 aa, Artificial Sequence
  Description of Artificial Sequence: Synthetic polypeptide
AENEIACTNPVATEQYGQCSCSWGEDNAENFNSQTQS

SEQ ID NO: 202480 - protein, 39 aa, Artificial Sequence
  Description of Artificial Sequence: Synthetic polypeptide
DDEEIRTTNPVATEQYGQCVCSNWGEDHNQENFISDPQS

SEQ ID NO: 202481 - protein, 39 aa, Artificial Sequence
  Description of Artificial Sequence: Synthetic polypeptide
DEAEISTTNPVATEQYGQCVCSNWGEDPNIENFNSETQA

SEQ ID NO: 202482 - protein, 37 aa, Artificial Sequence
  Description of Artificial Sequence: Synthetic polypeptide
AENEIACTNPVATEQYGQCSCSNWGEDNQEYFGSDQS

SEQ ID NO: 202483 - protein, 38 aa, Artificial Sequence
  Description of Artificial Sequence: Synthetic polypeptide
SDEEIRTTNPVATCQYGQCVCSNWGEDNQEYFNSDTQA

SEQ ID NO: 202484 - protein, 39 aa, Artificial Sequence
  Description of Artificial Sequence: Synthetic polypeptide
DEAEISTTNPVATEQYGQCVCSNWGEDPNAENFNSENQS

SEQ ID NO: 202485 - protein, 39 aa, Artificial Sequence
  Description of Artificial Sequence: Synthetic polypeptide
DEAEISTTNPVATEQYGQCVCSNWGEDPNAENFNSENQN

SEQ ID NO: 202486 - protein, 34 aa, Artificial Sequence
  Description of Artificial Sequence: Synthetic polypeptide
DEESIACTNPVATASWGCVAGTGENGPDDSYSDD

SEQ ID NO: 202487 - protein, 35 aa, Artificial Sequence
  Description of Artificial Sequence: Synthetic polypeptide
DEESIACTNPVATASWGCVAGTGENGPDDSVNHDD

SEQ ID NO: 202488 - protein, 39 aa, Artificial Sequence
  Description of Artificial Sequence: Synthetic polypeptide
DEAEISTTNPVATEQYGQCVCSNWGEDHNQEYFNSEFQS

SEQ ID NO: 202489 - protein, 37 aa, Artificial Sequence
  Description of Artificial Sequence: Synthetic polypeptide
SDEEISTTNPVATHQYGCVCSNWGEHNQENFGSDTQA

SEQ ID NO: 202490 - protein, 37 aa, Artificial Sequence
  Description of Artificial Sequence: Synthetic polypeptide
SEEEIRCTNPIATEQYGCVCSNWGEHNAENFMSDTQS

SEQ ID NO: 202491 - protein, 35 aa, Artificial Sequence
  Description of Artificial Sequence: Synthetic polypeptide
DEFEIRTTNPIATECWGAATWANAEDWAEPKGPYI

SEQ ID NO: 202492 - protein, 35 aa, Artificial Sequence
  Description of Artificial Sequence: Synthetic polypeptide
DEFEIRTTNPIATECWGATTWANAEDWAEPKGPYI

SEQ ID NO: 202493 - protein, 38 aa, Artificial Sequence
  Description of Artificial Sequence: Synthetic polypeptide
AEEEIRTTNPVCTEGYGCVCSNWGEDHNAENFGSDTQA

SEQ ID NO: 202494 - protein, 38 aa, Artificial Sequence
  Description of Artificial Sequence: Synthetic polypeptide
AEEEIRTTNPVSTEQYGQCVCGWGEDHNQEGFGSQTQS

SEQ ID NO: 202495 - protein, 35 aa, Artificial Sequence
  Description of Artificial Sequence: Synthetic polypeptide
DEAENATTNPCAYECWGCVAGPNGNQQLEGDTQRN

SEQ ID NO: 202496 - protein, 38 aa, Artificial Sequence
  Description of Artificial Sequence: Synthetic polypeptide
AEEEISCTNPVATEQYGCVCSNWGEDHNAENFISENQS

SEQ ID NO: 202497 - protein, 38 aa, Artificial Sequence
  Description of Artificial Sequence: Synthetic polypeptide
AEEEISCTNPVATEQYGCVCSNWGEDHNAENFNSDTQA

SEQ ID NO: 202498 - protein, 38 aa, Artificial Sequence
  Description of Artificial Sequence: Synthetic polypeptide
AEEEISCTNPVATEQYGCVCSNWGEDHNAENFNSDTQS

SEQ ID NO: 202499 - protein, 36 aa, Artificial Sequence
  Description of Artificial Sequence: Synthetic polypeptide
DEAEIATTNPVAYEQWGCVAGEGPIGNNAGNPNEDK

SEQ ID NO: 202500 - protein, 38 aa, Artificial Sequence
  Description of Artificial Sequence: Synthetic polypeptide
DEEEIATTNPVAYEQYGCGIPNPNEVGPQEASINEQTS

SEQ ID NO: 202501 - protein, 37 aa, Artificial Sequence
  Description of Artificial Sequence: Synthetic polypeptide
DDAEIRTTNPVATEQYGCCCSNWGEHNQEHFISQTQA

SEQ ID NO: 202502 - protein, 38 aa, Artificial Sequence
  Description of Artificial Sequence: Synthetic polypeptide
DEEEIATTNPVAYEQYGCQIPNINWVGPCEASINEQTS

SEQ ID NO: 202503 - protein, 38 aa, Artificial Sequence
  Description of Artificial Sequence: Synthetic polypeptide
ADEEISTTNPVATEQYGQCVCSNSGEHNAEYFNSETQP

SEQ ID NO: 202504 - protein, 39 aa, Artificial Sequence
  Description of Artificial Sequence: Synthetic polypeptide
DEECISTTNPVATEQYGQCVCSNWGYDHNAENFNSDTQA

SEQ ID NO: 202505 - protein, 38 aa, Artificial Sequence
  Description of Artificial Sequence: Synthetic polypeptide
CEEEIATTNPVATASWGHSVSSTGEGGINPRDGMEKVN

SEQ ID NO: 202506 - protein, 39 aa, Artificial Sequence
  Description of Artificial Sequence: Synthetic polypeptide
DEEEISTTNPVATEQYGQCVVCSNSGEHNEENFISDTQL

SEQ ID NO: 202507 - protein, 38 aa, Artificial Sequence
  Description of Artificial Sequence: Synthetic polypeptide
SEEEIRCTNPCAYEQYGQCVCSNWGEDNAEHFGSDNQS

SEQ ID NO: 202508 - protein, 37 aa, Artificial Sequence
  Description of Artificial Sequence: Synthetic polypeptide
DEEEIRTTNPIATECWGATTSSNAPDWPAMPNGMPPI

SEQ ID NO: 202509 - protein, 38 aa, Artificial Sequence
  Description of Artificial Sequence: Synthetic polypeptide
DEVEIKTTNPVATEQYGQYVVGDDGNENGEETDGEGQG

SEQ ID NO: 202510 - protein, 37 aa, Artificial Sequence
  Description of Artificial Sequence: Synthetic polypeptide
DEEEIRTTNPIATECWGATTSANAPDWPAMPNGMPPI

SEQ ID NO: 202511 - protein, 35 aa, Artificial Sequence
  Description of Artificial Sequence: Synthetic polypeptide
QESEIRTTNPVAYESWGVVTGGNAGNADNGGGTDG

SEQ ID NO: 202512 - protein, 38 aa, Artificial Sequence
  Description of Artificial Sequence: Synthetic polypeptide
AEMEISTTNPVATEQYGQCVCSNWGEHNAENFNSDNQA

SEQ ID NO: 202513 - protein, 35 aa, Artificial Sequence
  Description of Artificial Sequence: Synthetic polypeptide
DEHEIATTNPVAYQPWGHNIVATAGHMQAAEMGMD

SEQ ID NO: 202514 - protein, 39 aa, Artificial Sequence
  Description of Artificial Sequence: Synthetic polypeptide
AEEEIRTTNPVAYEQYGQCVCSNWGEDHNQENFNSDTQS

SEQ ID NO: 202515 - protein, 34 aa, Artificial Sequence
  Description of Artificial Sequence: Synthetic polypeptide
DESEIRTTNPIGTECWGVTWANAETWAEPKGDYI

SEQ ID NO: 202516 - protein, 34 aa, Artificial Sequence
  Description of Artificial Sequence: Synthetic polypeptide
DESEIRTTNPIGTECWGATWANAETWAEPKGDYI

SEQ ID NO: 202517 - protein, 38 aa, Artificial Sequence
  Description of Artificial Sequence: Synthetic polypeptide
DEEEIATTNPVAYEQWGVSTVCAMIEGLGPPDQGPSAM

SEQ ID NO: 202518 - protein, 38 aa, Artificial Sequence
  Description of Artificial Sequence: Synthetic polypeptide
DEEEIATTNPVAYEQWGVSTVCAMIEGLGPPDVQPSRM

SEQ ID NO: 202519 - protein, 35 aa, Artificial Sequence
  Description of Artificial Sequence: Synthetic polypeptide
CEEVIACTNPVATEQWGCVANMNNENAAGGPGEQM

SEQ ID NO: 202520 - protein, 38 aa, Artificial Sequence
  Description of Artificial Sequence: Synthetic polypeptide
AEMEISTTNPVATEQYGQCVCSNWEEHNAENFNSDTQS

SEQ ID NO: 202521 - protein, 37 aa, Artificial Sequence
  Description of Artificial Sequence: Synthetic polypeptide
DDAEIATTNPVATCQYGQCVCSWGAHNQEYFGSDTQS

SEQ ID NO: 202522 - protein, 37 aa, Artificial Sequence
  Description of Artificial Sequence: Synthetic polypeptide
CTDEIRTTNPVATEGYGSVNNDEFDEEEDEDGGNQGN

SEQ ID NO: 202523 - protein, 38 aa, Artificial Sequence
  Description of Artificial Sequence: Synthetic polypeptide
DDAEIRTTNPVATEQYGCCCSNWGEDHNAEHFNSQTQA

SEQ ID NO: 202524 - protein, 35 aa, Artificial Sequence
  Description of Artificial Sequence: Synthetic polypeptide
AENEIASTNPVGTEGYGVSCGSGEHNQEHFGSDQS

SEQ ID NO: 202525 - protein, 39 aa, Artificial Sequence
  Description of Artificial Sequence: Synthetic polypeptide
DDAEIGTTNPVATEQYGQCVCSNWGEDHNQEGFNSETQS

SEQ ID NO: 202526 - protein, 35 aa, Artificial Sequence
  Description of Artificial Sequence: Synthetic polypeptide
DENEIRTTNPISTEPWGTTISNMEDIQAQQNGPYI

SEQ ID NO: 202527 - protein, 39 aa, Artificial Sequence
  Description of Artificial Sequence: Synthetic polypeptide
AEEEIRTTNPVAYEQYGQCVCSNWGEDHNAENFNSDTQP

SEQ ID NO: 202528 - protein, 39 aa, Artificial Sequence
  Description of Artificial Sequence: Synthetic polypeptide
AEEEIRTTNPVAYEQYGQCVCSNWGEDHNAENFNSDTQS

SEQ ID NO: 202529 - protein, 39 aa, Artificial Sequence
  Description of Artificial Sequence: Synthetic polypeptide
AEEEIRTTNPVAYEQYGQCVCSNWGEDHNDEYFNSDTQS

SEQ ID NO: 202530 - protein, 38 aa, Artificial Sequence
  Description of Artificial Sequence: Synthetic polypeptide
DDAEIRCTNPVATEQYGQCVCSNWGEHNQENSNSQTQA

SEQ ID NO: 202531 - protein, 35 aa, Artificial Sequence
  Description of Artificial Sequence: Synthetic polypeptide
DEHEIATTNPVAYESWGVCASGGPGEDERNMNGTY

SEQ ID NO: 202532 - protein, 37 aa, Artificial Sequence
  Description of Artificial Sequence: Synthetic polypeptide
DEEEIRTTNPIATECWGATTWSNAPDWPNEPNGMPYI

SEQ ID NO: 202533 - protein, 40 aa, Artificial Sequence
  Description of Artificial Sequence: Synthetic polypeptide
DEEEIRTTNPVATEQYGTSWVIHPCSVEEYGEVIMTTPEL

SEQ ID NO: 202534 - protein, 38 aa, Artificial Sequence
  Description of Artificial Sequence: Synthetic polypeptide
AEMEISTTNPVATEQYGQCVCSNWGEHNAENFNSDNQS

SEQ ID NO: 202535 - protein, 37 aa, Artificial Sequence
  Description of Artificial Sequence: Synthetic polypeptide
AEEEISTTNPCATEGYGCCCSTWGEHNAENFGSDTQA

SEQ ID NO: 202536 - protein, 38 aa, Artificial Sequence
  Description of Artificial Sequence: Synthetic polypeptide
AEMEISTTNPVATEQYGQCVCSNWGEHNAENFNSDTQS

SEQ ID NO: 202537 - protein, 38 aa, Artificial Sequence
  Description of Artificial Sequence: Synthetic polypeptide
AEEEISTTNPVATEEYGQCSCSNWGEHNAENFNSDTQA

SEQ ID NO: 202538 - protein, 37 aa, Artificial Sequence
  Description of Artificial Sequence: Synthetic polypeptide
DEEEIATTNPVAYEQYGCTIPNENVGPCEASIEEQTS

SEQ ID NO: 202539 - protein, 38 aa, Artificial Sequence
  Description of Artificial Sequence: Synthetic polypeptide
DEEEIATTNPVAYEQYGCTIPNPNDVGPCEASINEQTK

SEQ ID NO: 202540 - protein, 38 aa, Artificial Sequence
  Description of Artificial Sequence: Synthetic polypeptide
DEAEISTTNPVAYEQYGQCVCSNWGEHNAENFGSETQP

SEQ ID NO: 202541 - protein, 37 aa, Artificial Sequence
  Description of Artificial Sequence: Synthetic polypeptide
DEECIRTTNPVATEGYGCVCQWGEDHNQENFISDTQA

SEQ ID NO: 202542 - protein, 39 aa, Artificial Sequence
  Description of Artificial Sequence: Synthetic polypeptide
DEAEISTTNPVATEQYGQCVCSNWMEDHNAENFNSDTQA

SEQ ID NO: 202543 - protein, 37 aa, Artificial Sequence
  Description of Artificial Sequence: Synthetic polypeptide
DEESIACTNPVATEQWGGCCTAAGANDADGNTAGAGM

SEQ ID NO: 202544 - protein, 37 aa, Artificial Sequence
  Description of Artificial Sequence: Synthetic polypeptide
AEEEISTTNPVATEGYGCVCFNWGEHNTEYFNSDTQA

SEQ ID NO: 202545 - protein, 38 aa, Artificial Sequence
  Description of Artificial Sequence: Synthetic polypeptide
DEEEIATTNPVAYEQYGCQIPNPNVGPCCEASINEGTS

SEQ ID NO: 202546 - protein, 38 aa, Artificial Sequence
  Description of Artificial Sequence: Synthetic polypeptide
DEAEISTTNPVAYEQYGQCVCSNWGEHNAENFISDNQS

SEQ ID NO: 202547 - protein, 39 aa, Artificial Sequence
  Description of Artificial Sequence: Synthetic polypeptide
CEEEIRTTNPVATEQYGQCVCGNWMEDHNAENFNSDNQS

SEQ ID NO: 202548 - protein, 38 aa, Artificial Sequence
  Description of Artificial Sequence: Synthetic polypeptide
DEECISTTNPVATEQYGQCVCSNWGEHNAENFISDTQS

SEQ ID NO: 202549 - protein, 37 aa, Artificial Sequence
  Description of Artificial Sequence: Synthetic polypeptide
CEEEIATTNPVATEMWGHAVVAGTGAGDADTPGGENH

SEQ ID NO: 202550 - protein, 35 aa, Artificial Sequence
  Description of Artificial Sequence: Synthetic polypeptide
DDSEIATTNPVSTEGWGATVWAAAEDIAERKGQYR

SEQ ID NO: 202551 - protein, 39 aa, Artificial Sequence
  Description of Artificial Sequence: Synthetic polypeptide
DEAEISTTNPVATEQYGQCVCSNWMEDHNAEFFNSDTQS

SEQ ID NO: 202552 - protein, 38 aa, Artificial Sequence
  Description of Artificial Sequence: Synthetic polypeptide
AEEEISTTNPVATEGYGCVCSNWGEDHNAENFNSDTQA

SEQ ID NO: 202553 - protein, 39 aa, Artificial Sequence
  Description of Artificial Sequence: Synthetic polypeptide
DEEEIRTTNPEATCQYGQCVCQNWGEDHNQEYFGSDTQA

SEQ ID NO: 202554 - protein, 35 aa, Artificial Sequence
  Description of Artificial Sequence: Synthetic polypeptide
DEFEIRTTNPIATECWGATTWANAEVWAEPKGPYI

SEQ ID NO: 202555 - protein, 38 aa, Artificial Sequence
  Description of Artificial Sequence: Synthetic polypeptide
DEAEISTTNPVAYEQYGQCVCSNWGEHNAENFNSDTQL

SEQ ID NO: 202556 - protein, 36 aa, Artificial Sequence
  Description of Artificial Sequence: Synthetic polypeptide
CQAEIACTNPVATEQWGCFVATGELADIGNSDESAM

SEQ ID NO: 202557 - protein, 38 aa, Artificial Sequence
  Description of Artificial Sequence: Synthetic polypeptide
DEAEISTTNPVAYEQYGQCVCSNWGEHNAENFFSDNQA

SEQ ID NO: 202558 - protein, 38 aa, Artificial Sequence
  Description of Artificial Sequence: Synthetic polypeptide
AEEEISTTNPVATEAYGQCVCSNWGEHNAENFNSDNQL

SEQ ID NO: 202559 - protein, 38 aa, Artificial Sequence
  Description of Artificial Sequence: Synthetic polypeptide
AEMEISTTNPVATEQYGQCVCSNWGEHNAENFNSETQS

SEQ ID NO: 202560 - protein, 38 aa, Artificial Sequence
  Description of Artificial Sequence: Synthetic polypeptide
AEMEISTTNPVATEQYGQCVCSNWGEPNEEFFGSDTQA

SEQ ID NO: 202561 - protein, 36 aa, Artificial Sequence
  Description of Artificial Sequence: Synthetic polypeptide
DEAEIATTNPVAYEQWGHCIMAGNSGLVDNDSNDAE

SEQ ID NO: 202562 - protein, 39 aa, Artificial Sequence
  Description of Artificial Sequence: Synthetic polypeptide
DEECIRTTNPVATEGYGQCVCSNWEEDHNAENFNSDNQS

SEQ ID NO: 202563 - protein, 35 aa, Artificial Sequence
  Description of Artificial Sequence: Synthetic polypeptide
DEAEIATTNPVAYEQWGNCIAGEHGGENPAGEGMD

SEQ ID NO: 202564 - protein, 36 aa, Artificial Sequence
  Description of Artificial Sequence: Synthetic polypeptide
DEAEIATTNPVAYEQWGNCIAGEHGGENPAGGNNMD

SEQ ID NO: 202565 - protein, 39 aa, Artificial Sequence
  Description of Artificial Sequence: Synthetic polypeptide
DEECIRTTNPVATEGYGQCVCSMWGEDHNAENFNSENQP

SEQ ID NO: 202566 - protein, 37 aa, Artificial Sequence
  Description of Artificial Sequence: Synthetic polypeptide
SEEEIRCTNPEAYEQYGCVCSNWGEHNAENFGSDTQS

SEQ ID NO: 202567 - protein, 38 aa, Artificial Sequence
  Description of Artificial Sequence: Synthetic polypeptide
AEEEISTTNPCATEQYGQCVCSNWGEHNAENFNSDTQS

SEQ ID NO: 202568 - protein, 35 aa, Artificial Sequence
  Description of Artificial Sequence: Synthetic polypeptide
DEVEIRTTNPIATECWGATTWANAEDWAEPKGPCI

SEQ ID NO: 202569 - protein, 35 aa, Artificial Sequence
  Description of Artificial Sequence: Synthetic polypeptide
DEVEIRTTNPIATECWGATTWANAEDWAEPKGPYI

SEQ ID NO: 202570 - protein, 36 aa, Artificial Sequence
  Description of Artificial Sequence: Synthetic polypeptide
DEVEIRTTNPIATECWGATVWANAEDWAEPKGKPYI

SEQ ID NO: 202571 - protein, 37 aa, Artificial Sequence
  Description of Artificial Sequence: Synthetic polypeptide
CEEEIATTNPVATASWGSVTSANGAGGTAPQDIADTK

SEQ ID NO: 202572 - protein, 37 aa, Artificial Sequence
  Description of Artificial Sequence: Synthetic polypeptide
DENEIRTTNPVAYEQWGCVCSNWGEENTEYFISDTAS

SEQ ID NO: 202573 - protein, 36 aa, Artificial Sequence
  Description of Artificial Sequence: Synthetic polypeptide
CEEEIATTNPVATASWGTNVCSAAANHGMYDSNDSW

SEQ ID NO: 202574 - protein, 38 aa, Artificial Sequence
  Description of Artificial Sequence: Synthetic polypeptide
DEAEISTTNPVAYEQYGQCVCSNWGEDNIENFNSDNQA

SEQ ID NO: 202575 - protein, 36 aa, Artificial Sequence
  Description of Artificial Sequence: Synthetic polypeptide
AEEEISTTNPEATCQYGCVCPWGEHNAEYFGSDTQS

SEQ ID NO: 202576 - protein, 39 aa, Artificial Sequence
  Description of Artificial Sequence: Synthetic polypeptide
DEAEISTTNPVATEQYGQCVCSTWGEDHNAENFISETQS

SEQ ID NO: 202577 - protein, 38 aa, Artificial Sequence
  Description of Artificial Sequence: Synthetic polypeptide
DEAEISTTNPVAYEQYGQCVCSNWGEHNAEGFNSETQS

SEQ ID NO: 202578 - protein, 38 aa, Artificial Sequence
  Description of Artificial Sequence: Synthetic polypeptide
AEEEISTTNPVATEGYGCVCSNWGEDHNAENFNSDTQS

SEQ ID NO: 202579 - protein, 35 aa, Artificial Sequence
  Description of Artificial Sequence: Synthetic polypeptide
DESEIRTTNPIATECWGATYYANVNDWDEKKGPYI

SEQ ID NO: 202580 - protein, 37 aa, Artificial Sequence
  Description of Artificial Sequence: Synthetic polypeptide
SDEEIRCTNPCATEQYGCVCSNWMEDNAENFGSDTQS

SEQ ID NO: 202581 - protein, 38 aa, Artificial Sequence
  Description of Artificial Sequence: Synthetic polypeptide
DEMEISTTNPVAYEQYGQCVCSNWGEHNAENFNSETQA

SEQ ID NO: 202582 - protein, 35 aa, Artificial Sequence
  Description of Artificial Sequence: Synthetic polypeptide
DESEIRTTNPIATECWGATTVACAEDWAEPPGPYI

SEQ ID NO: 202583 - protein, 34 aa, Artificial Sequence
  Description of Artificial Sequence: Synthetic polypeptide
QETEIATTNPVATASWGCVAGEGEEMNAALDNHK

SEQ ID NO: 202584 - protein, 35 aa, Artificial Sequence
  Description of Artificial Sequence: Synthetic polypeptide
DESEIRTTNPIATECWGATTCANAEDWAEPTGPYI

SEQ ID NO: 202585 - protein, 39 aa, Artificial Sequence
  Description of Artificial Sequence: Synthetic polypeptide
DEAEISTTNPVATEQYGQCVCSNWGEDHNAESFNSDTQS

SEQ ID NO: 202586 - protein, 39 aa, Artificial Sequence
  Description of Artificial Sequence: Synthetic polypeptide
DEAEISTTNPVATEQYGQCVCSNWGEDHNAENFNSDTQS

SEQ ID NO: 202587 - protein, 35 aa, Artificial Sequence
  Description of Artificial Sequence: Synthetic polypeptide
DSSEVASTNPVSYEWYGNVVACNTISQSQVGGSNR

SEQ ID NO: 202588 - protein, 39 aa, Artificial Sequence
  Description of Artificial Sequence: Synthetic polypeptide
DEAEISTTNPVATEQYGQCVCSNWGEDHNAENFNSDTQA

SEQ ID NO: 202589 - protein, 35 aa, Artificial Sequence
  Description of Artificial Sequence: Synthetic polypeptide
DSSEVASTNPVSYEPYGNVVACNTHSQIHVGGQNR

SEQ ID NO: 202590 - protein, 39 aa, Artificial Sequence
  Description of Artificial Sequence: Synthetic polypeptide
DEAEISTTNPVATEQYGQCVCSNWGEDHNAEYFNSDNQA

SEQ ID NO: 202591 - protein, 36 aa, Artificial Sequence
  Description of Artificial Sequence: Synthetic polypeptide
CEEEIACTNPVATEQWGCNNATNGAHTNPPDQTEGM

SEQ ID NO: 202592 - protein, 39 aa, Artificial Sequence
  Description of Artificial Sequence: Synthetic polypeptide
DEEEISTTNPVAYEGYGQCVCSNWGEDHNQENFGSDNQS

SEQ ID NO: 202593 - protein, 39 aa, Artificial Sequence
  Description of Artificial Sequence: Synthetic polypeptide
DDEEISTTNPVATEQYGQCQVCSNWGEHNTENFGSDTQS

SEQ ID NO: 202594 - protein, 39 aa, Artificial Sequence
  Description of Artificial Sequence: Synthetic polypeptide
DEEEISTTNPVAYEGYGQCVCSNWGEDHNTENFISDNQA

SEQ ID NO: 202595 - protein, 38 aa, Artificial Sequence
  Description of Artificial Sequence: Synthetic polypeptide
DEEEISTTNPVAYEGYGQCVCSNWGEHNAENFFSDNQS

SEQ ID NO: 202596 - protein, 38 aa, Artificial Sequence
  Description of Artificial Sequence: Synthetic polypeptide
DEEEISTTNPVAYEGYGQCVCSNWGEHNAENFGSETQS

SEQ ID NO: 202597 - protein, 38 aa, Artificial Sequence
  Description of Artificial Sequence: Synthetic polypeptide
DEEEISTTNPVAYEGYGQCVCSNWGEHNAENFNSDTQA

SEQ ID NO: 202598 - protein, 38 aa, Artificial Sequence
  Description of Artificial Sequence: Synthetic polypeptide
DEEEISTTNPVAYEGYGQCVCSNWGEHNAENFNSDTQG

SEQ ID NO: 202599 - protein, 38 aa, Artificial Sequence
  Description of Artificial Sequence: Synthetic polypeptide
DEEEISTTNPVAYEGYGQCVCSNWGEHNAENFNSDTQN

SEQ ID NO: 202600 - protein, 39 aa, Artificial Sequence
  Description of Artificial Sequence: Synthetic polypeptide
DDEEISTTNPVATEQYGQCAVCSNWGEDNAENFNSDTQS

SEQ ID NO: 202601 - protein, 35 aa, Artificial Sequence
  Description of Artificial Sequence: Synthetic polypeptide
DEYEIRTTNPIATECWGATTVANAEDWAEPKGPYI

SEQ ID NO: 202602 - protein, 34 aa, Artificial Sequence
  Description of Artificial Sequence: Synthetic polypeptide
DESEIRTTNPIATECWGATTWAAEDWAEPKGPYI

SEQ ID NO: 202603 - protein, 36 aa, Artificial Sequence
  Description of Artificial Sequence: Synthetic polypeptide
DESEIATTNPMAYEAWGISVPVNATSSSDREGGMVC

SEQ ID NO: 202604 - protein, 33 aa, Artificial Sequence
  Description of Artificial Sequence: Synthetic polypeptide
QETEIATTNPIATEQWGEAANAEVWAEHKGEYK

SEQ ID NO: 202605 - protein, 35 aa, Artificial Sequence
  Description of Artificial Sequence: Synthetic polypeptide
DESEIRTTNPIATECWGATTWANAEDWAEPKRPYI

SEQ ID NO: 202606 - protein, 35 aa, Artificial Sequence
  Description of Artificial Sequence: Synthetic polypeptide
DESEIRTTNPIATECWGATTWANAEDWAEPKGPYI

SEQ ID NO: 202607 - protein, 35 aa, Artificial Sequence
  Description of Artificial Sequence: Synthetic polypeptide
DESEIRTTNPIATECWGATTWANAEDWAEPKGPYG

SEQ ID NO: 202608 - protein, 39 aa, Artificial Sequence
  Description of Artificial Sequence: Synthetic polypeptide
DEECISTTNPVATEQYGQCVCSNWGEGHNAENFNSDTQA

SEQ ID NO: 202609 - protein, 36 aa, Artificial Sequence
  Description of Artificial Sequence: Synthetic polypeptide
AENEIACTNPVATEGYGCSCSWGEDNQENFNSQTQS

SEQ ID NO: 202610 - protein, 39 aa, Artificial Sequence
  Description of Artificial Sequence: Synthetic polypeptide
DEEEISTTNPVAYEGYGQCVCSMWGEDTNAEHFNSENQP

SEQ ID NO: 202611 - protein, 36 aa, Artificial Sequence
  Description of Artificial Sequence: Synthetic polypeptide
DEMEISTTNPVATEGYGCVCQWGEHNIENFMSDTQS

SEQ ID NO: 202612 - protein, 35 aa, Artificial Sequence
  Description of Artificial Sequence: Synthetic polypeptide
DSTEIRTTNPIATECWGVTTWANAEDWAEPKGPYI

SEQ ID NO: 202613 - protein, 38 aa, Artificial Sequence
  Description of Artificial Sequence: Synthetic polypeptide
DEMEISTTNPVATEGYGCVCSNWGEDHNAENFNSENQS

SEQ ID NO: 202614 - protein, 36 aa, Artificial Sequence
  Description of Artificial Sequence: Synthetic polypeptide
AENEIACTNPVATEGYGCVCSNWGEDNQHFISENQA

SEQ ID NO: 202615 - protein, 38 aa, Artificial Sequence
  Description of Artificial Sequence: Synthetic polypeptide
DEEEISTTNPVAYEGYGQCVCSNSGEHNQENFGSDTQS

SEQ ID NO: 202616 - protein, 36 aa, Artificial Sequence
  Description of Artificial Sequence: Synthetic polypeptide
DTAEIATTNPVAYEQWGCVYNNVVRPEDVQDIHNAS

SEQ ID NO: 202617 - protein, 39 aa, Artificial Sequence
  Description of Artificial Sequence: Synthetic polypeptide
DEMAIATTNPVATEQYGQCVCSTWGEDHNEEHFGSETQA

SEQ ID NO: 202618 - protein, 39 aa, Artificial Sequence
  Description of Artificial Sequence: Synthetic polypeptide
DEAEISTTNPVATEQYGQCVCSNWGEDHNAEYFNSETQA

SEQ ID NO: 202619 - protein, 38 aa, Artificial Sequence
  Description of Artificial Sequence: Synthetic polypeptide
DEEEISTTNPVAYEGYGQCVCSNWEEHNTEHFNSDTQS

SEQ ID NO: 202620 - protein, 39 aa, Artificial Sequence
  Description of Artificial Sequence: Synthetic polypeptide
DEAEISTTNPVATEQYGQCVCSNWGEDHNAEYFNSDTQS

SEQ ID NO: 202621 - protein, 37 aa, Artificial Sequence
  Description of Artificial Sequence: Synthetic polypeptide
DDEAISTTNPVATEGYGCVCSNWGEHNEESFNSDTQA

SEQ ID NO: 202622 - protein, 39 aa, Artificial Sequence
  Description of Artificial Sequence: Synthetic polypeptide
DEAEISTTNPVATEQYGQCVCSNWGEDHNAEYFNSETQS

SEQ ID NO: 202623 - protein, 38 aa, Artificial Sequence
  Description of Artificial Sequence: Synthetic polypeptide
DDEEISTTNPVATEQYGQCVCGNWGEHNAEYFNSDNQA

SEQ ID NO: 202624 - protein, 38 aa, Artificial Sequence
  Description of Artificial Sequence: Synthetic polypeptide
DEEEISTTNPVAYEGYGQCVCSNWGEHNAENFNSETQA

SEQ ID NO: 202625 - protein, 38 aa, Artificial Sequence
  Description of Artificial Sequence: Synthetic polypeptide
DEEEISTTNPVAYEGYGQCVCSNWGEHNAENFNSQTQS

SEQ ID NO: 202626 - protein, 39 aa, Artificial Sequence
  Description of Artificial Sequence: Synthetic polypeptide
DEECISTTNPVATEQYGQCVCSNWGEDHNQEGFGSETQS

SEQ ID NO: 202627 - protein, 39 aa, Artificial Sequence
  Description of Artificial Sequence: Synthetic polypeptide
DEECISTTNPVATEQYGQCVCSNWGEDHNQEFFGSDTQS

SEQ ID NO: 202628 - protein, 39 aa, Artificial Sequence
  Description of Artificial Sequence: Synthetic polypeptide
DDEEISTTNPVATEQYGQCVCSMWGEDHNAENFNSDTQS

SEQ ID NO: 202629 - protein, 34 aa, Artificial Sequence
  Description of Artificial Sequence: Synthetic polypeptide
DESEIRTTNPIATECWGATTAAEDWPAEPEGPYI

SEQ ID NO: 202630 - protein, 39 aa, Artificial Sequence
  Description of Artificial Sequence: Synthetic polypeptide
DEMEISTTNPVATEGYGQCVCSNWGEDHNTENFNSDNQA

SEQ ID NO: 202631 - protein, 36 aa, Artificial Sequence
  Description of Artificial Sequence: Synthetic polypeptide
DSSEVASTNPVSYEGYGNVVQACNTSSQSRVGGQNR

SEQ ID NO: 202632 - protein, 39 aa, Artificial Sequence
  Description of Artificial Sequence: Synthetic polypeptide
DDEEISTTNPVATEQYGQCVCSNSGEDHNAEYFNSDTQS

SEQ ID NO: 202633 - protein, 37 aa, Artificial Sequence
  Description of Artificial Sequence: Synthetic polypeptide
DDAEISTTNPVATCQYGCVCSNWGEPNAENFGSETQS

SEQ ID NO: 202634 - protein, 39 aa, Artificial Sequence
  Description of Artificial Sequence: Synthetic polypeptide
DEECISTTNPVATEQYGQCVCSNWGEDHNQENFGSDTQA

SEQ ID NO: 202635 - protein, 39 aa, Artificial Sequence
  Description of Artificial Sequence: Synthetic polypeptide
DDEEISTTNPVATEQYGQCVCSNWEADHNAENFNSDNQS

SEQ ID NO: 202636 - protein, 39 aa, Artificial Sequence
  Description of Artificial Sequence: Synthetic polypeptide
DEEEISTTNPVAYEQYGCQVCSNWGEDHNAENFNSDNQS

SEQ ID NO: 202637 - protein, 39 aa, Artificial Sequence
  Description of Artificial Sequence: Synthetic polypeptide
DDEEISTTNPVATEQYGQCVCSNWEEDHNAEFFQSDFQA

SEQ ID NO: 202638 - protein, 38 aa, Artificial Sequence
  Description of Artificial Sequence: Synthetic polypeptide
DEEEISTTNPVAYEQYGCVCGNWGEDHNAENFISETQS

SEQ ID NO: 202639 - protein, 38 aa, Artificial Sequence
  Description of Artificial Sequence: Synthetic polypeptide
DEEEISTTNPVAYEQYGCVCGNWGEDHNEESFNSDTQD

SEQ ID NO: 202640 - protein, 38 aa, Artificial Sequence
  Description of Artificial Sequence: Synthetic polypeptide
DEEEISTTNPVAYEQYGCVCQTWGEDHNQEYFDSDTQS

SEQ ID NO: 202641 - protein, 39 aa, Artificial Sequence
  Description of Artificial Sequence: Synthetic polypeptide
DEECISTTNPVATEQYGQCVCSNWGEDHNEENFGSDTQS

SEQ ID NO: 202642 - protein, 39 aa, Artificial Sequence
  Description of Artificial Sequence: Synthetic polypeptide
DEECISTTNPVATEQYGQCVCSNWGEDHNDENFNSDTQS

SEQ ID NO: 202643 - protein, 39 aa, Artificial Sequence
  Description of Artificial Sequence: Synthetic polypeptide
DDEEISTTNPVATEQYGQCVCSNWGEDDNAEFFNSDTQG

SEQ ID NO: 202644 - protein, 39 aa, Artificial Sequence
  Description of Artificial Sequence: Synthetic polypeptide
DEEEISTTNPVAYEQYGCIVCSNWGEDHNTENFNSETQS

SEQ ID NO: 202645 - protein, 39 aa, Artificial Sequence
  Description of Artificial Sequence: Synthetic polypeptide
DDEEISTTNPVATEQYGQCVCSMWGEDDNAENFNSDTQS

SEQ ID NO: 202646 - protein, 39 aa, Artificial Sequence
  Description of Artificial Sequence: Synthetic polypeptide
DDEEISTTNPVATEQYGQCVCSMWGEDDNAENFNSDNQA

SEQ ID NO: 202647 - protein, 39 aa, Artificial Sequence
  Description of Artificial Sequence: Synthetic polypeptide
DDEEISTTNPVATEQYGQCVCSDWGEDHNQEGFGSDTQS

SEQ ID NO: 202648 - protein, 38 aa, Artificial Sequence
  Description of Artificial Sequence: Synthetic polypeptide
DEEEISTTNPVAYEGYGQCVCSNWGEHNEEYFNSDTQP

SEQ ID NO: 202649 - protein, 35 aa, Artificial Sequence
  Description of Artificial Sequence: Synthetic polypeptide
DEYEIRTTNPIATECWGATTWANAEDWAEPKGPYI

SEQ ID NO: 202650 - protein, 37 aa, Artificial Sequence
  Description of Artificial Sequence: Synthetic polypeptide
CEEEIACTNPVATEQWGCNCNAASNLDQTAPDGEMMH

SEQ ID NO: 202651 - protein, 39 aa, Artificial Sequence
  Description of Artificial Sequence: Synthetic polypeptide
DDEEISTTNPVATEQYGQCVCSDSGEDHNAENFMSDNQA

SEQ ID NO: 202652 - protein, 37 aa, Artificial Sequence
  Description of Artificial Sequence: Synthetic polypeptide
DEMCISTTNPVATEQYGCICSNWGETNIENFISDTQS

SEQ ID NO: 202653 - protein, 38 aa, Artificial Sequence
  Description of Artificial Sequence: Synthetic polypeptide
DEEEISTTNPVAYEGYGQCVCSNWGEHNQENFGSETQG

SEQ ID NO: 202654 - protein, 39 aa, Artificial Sequence
  Description of Artificial Sequence: Synthetic polypeptide
DEAEISTTNPVATEQYGQCVCSNWGEDHNAENFNSDNQS

SEQ ID NO: 202655 - protein, 35 aa, Artificial Sequence
  Description of Artificial Sequence: Synthetic polypeptide
DSSEVASTNPVSYEPYGNVVAALTISGSRVGGQNR

SEQ ID NO: 202656 - protein, 35 aa, Artificial Sequence
  Description of Artificial Sequence: Synthetic polypeptide
DSSEVASTNPVSYEPYGNVACNATAISQSRVGGQR

SEQ ID NO: 202657 - protein, 35 aa, Artificial Sequence
  Description of Artificial Sequence: Synthetic polypeptide
DSSEVASTNPVSYEPYGKVVAANTASQIHVGGTNR

SEQ ID NO: 202658 - protein, 39 aa, Artificial Sequence
  Description of Artificial Sequence: Synthetic polypeptide
DEEEISTTNPVAYEGYGQCVCSTWMEDHNAEYFNSQTQA

SEQ ID NO: 202659 - protein, 38 aa, Artificial Sequence
  Description of Artificial Sequence: Synthetic polypeptide
DEEEISTTNPVAYEGYGQCVCSWGEDHNQENFNSDNQG

SEQ ID NO: 202660 - protein, 39 aa, Artificial Sequence
  Description of Artificial Sequence: Synthetic polypeptide
DDEEISTTNPVATEQYGQCVCSDWGEDHNAENFNSDTQA

SEQ ID NO: 202661 - protein, 35 aa, Artificial Sequence
  Description of Artificial Sequence: Synthetic polypeptide
QETEIATTNPVATECYGATTWANEECWAEHKGEYI

SEQ ID NO: 202662 - protein, 39 aa, Artificial Sequence
  Description of Artificial Sequence: Synthetic polypeptide
DEECISTTNPVATEQYGQCVCSNWGEDHNTEYFNSDTQA

SEQ ID NO: 202663 - protein, 39 aa, Artificial Sequence
  Description of Artificial Sequence: Synthetic polypeptide
DEECISTTNPVATEQYGQCVCSNWGEDHNQENFNSQTQA

SEQ ID NO: 202664 - protein, 39 aa, Artificial Sequence
  Description of Artificial Sequence: Synthetic polypeptide
DEEEISTTNPVAYEQWGQCVCSNWGEDHNQENFGSDNQA

SEQ ID NO: 202665 - protein, 38 aa, Artificial Sequence
  Description of Artificial Sequence: Synthetic polypeptide
DEEEISTTNPVAYEQWGQCVCSNWGEHNAENFNSDNQG

SEQ ID NO: 202666 - protein, 39 aa, Artificial Sequence
  Description of Artificial Sequence: Synthetic polypeptide
DEEEISTTNPVAYEQWGQCVCSTWGEDHNAENFNSDTQS

SEQ ID NO: 202667 - protein, 35 aa, Artificial Sequence
  Description of Artificial Sequence: Synthetic polypeptide
DESEIRTTNPIATECWGATTWANAEDWAEPVGQYI

SEQ ID NO: 202668 - protein, 35 aa, Artificial Sequence
  Description of Artificial Sequence: Synthetic polypeptide
DESEIRTTNPIATECWGATTWANAENWAEPEGPYI

SEQ ID NO: 202669 - protein, 35 aa, Artificial Sequence
  Description of Artificial Sequence: Synthetic polypeptide
DESEIRTTNPIATECWGATTWANAENWAEPKGPYI

SEQ ID NO: 202670 - protein, 38 aa, Artificial Sequence
  Description of Artificial Sequence: Synthetic polypeptide
DEMEISTTNPVATEGWGQCVCSTWGEENAEYFGSDTQS

SEQ ID NO: 202671 - protein, 36 aa, Artificial Sequence
  Description of Artificial Sequence: Synthetic polypeptide
AENEIACTNPVATEAYGCSCSNWGEHNAYFGSDTQS

SEQ ID NO: 202672 - protein, 36 aa, Artificial Sequence
  Description of Artificial Sequence: Synthetic polypeptide
AENEIACTNPVATEAYGCSCSNWGEHNQNFGSDTQA

SEQ ID NO: 202673 - protein, 37 aa, Artificial Sequence
  Description of Artificial Sequence: Synthetic polypeptide
AENEIACTNPVATEAYGCSCSTWGEHNAENFGSQTQS

SEQ ID NO: 202674 - protein, 38 aa, Artificial Sequence
  Description of Artificial Sequence: Synthetic polypeptide
AEEEISTTNPVATEGYGQCVCSWGEDHNAENFNSDTQS

SEQ ID NO: 202675 - protein, 39 aa, Artificial Sequence
  Description of Artificial Sequence: Synthetic polypeptide
DEEEISTTNPVAWEQYGQCVCSNWGEDDNQENFNSETQQ

SEQ ID NO: 202676 - protein, 38 aa, Artificial Sequence
  Description of Artificial Sequence: Synthetic polypeptide
DEESIACTNPVATAQWGSVCSEANPALPNDHGDGMGHW

SEQ ID NO: 202677 - protein, 35 aa, Artificial Sequence
  Description of Artificial Sequence: Synthetic polypeptide
DESEIRTTNPIATECWGATVWACEDWAEPKGEPYI

SEQ ID NO: 202678 - protein, 38 aa, Artificial Sequence
  Description of Artificial Sequence: Synthetic polypeptide
DEEEISTTNPVAYCQYGQCVCSNWGEDHNQNFNSDTQS

SEQ ID NO: 202679 - protein, 39 aa, Artificial Sequence
  Description of Artificial Sequence: Synthetic polypeptide
DEEEISTTNPVATEYYGQCVCSNWGEDHNAEHFNSDNQS

SEQ ID NO: 202680 - protein, 37 aa, Artificial Sequence
  Description of Artificial Sequence: Synthetic polypeptide
CEEEIACTNPVATEQWGCNVAMTADLTNPDDGMGDTH

SEQ ID NO: 202681 - protein, 38 aa, Artificial Sequence
  Description of Artificial Sequence: Synthetic polypeptide
DEEEISTTNPVAYEAYGQCVCSNWGEHNIESFNSETQS

SEQ ID NO: 202682 - protein, 38 aa, Artificial Sequence
  Description of Artificial Sequence: Synthetic polypeptide
AEEEISTTNPVATEQYGCSCSNWGEDDNQENFDSDTQS

SEQ ID NO: 202683 - protein, 35 aa, Artificial Sequence
  Description of Artificial Sequence: Synthetic polypeptide
DESEIRTTNPIATECWGATVANAIDWPAEPEGPYI

SEQ ID NO: 202684 - protein, 38 aa, Artificial Sequence
  Description of Artificial Sequence: Synthetic polypeptide
AEEEISTTNPVATEQYGCVCGNWGEDHNAENFNSDTQS

SEQ ID NO: 202685 - protein, 36 aa, Artificial Sequence
  Description of Artificial Sequence: Synthetic polypeptide
DTEEIATTNPVAYEEWGCVYNNVVRPEDVQKDHNAS

SEQ ID NO: 202686 - protein, 36 aa, Artificial Sequence
  Description of Artificial Sequence: Synthetic polypeptide
DTEEIATTNPVATAQWGGCCAGNFAGLEATANGEFN

SEQ ID NO: 202687 - protein, 37 aa, Artificial Sequence
  Description of Artificial Sequence: Synthetic polypeptide
DEMEISTTNPVATCQYGCVCNNWGEHNIEYFGSDTQA

SEQ ID NO: 202688 - protein, 39 aa, Artificial Sequence
  Description of Artificial Sequence: Synthetic polypeptide
DEEEISTTNPVAYEEYGQCVCSNWGEDHNAENFGSDNQP

SEQ ID NO: 202689 - protein, 39 aa, Artificial Sequence
  Description of Artificial Sequence: Synthetic polypeptide
DEAEISTTNPVATEQYGQCVCSNWGEDHNIENSNSDTQA

SEQ ID NO: 202690 - protein, 39 aa, Artificial Sequence
  Description of Artificial Sequence: Synthetic polypeptide
DEAEISTTNPVATEQYGQCVCSNWGEDHNQEHSNSDNQS

SEQ ID NO: 202691 - protein, 38 aa, Artificial Sequence
  Description of Artificial Sequence: Synthetic polypeptide
DEVEISTTNPVATEQYGVIIVDDLTQIMDGGDDGGEVD

SEQ ID NO: 202692 - protein, 39 aa, Artificial Sequence
  Description of Artificial Sequence: Synthetic polypeptide
DEEEISTTNPVATEYYGQCVCSNWGEDDNAENFNSDNQS

SEQ ID NO: 202693 - protein, 39 aa, Artificial Sequence
  Description of Artificial Sequence: Synthetic polypeptide
DEAEISTTNPVAYEQYGQCVCSTWGEDHNAENFNSDTQS

SEQ ID NO: 202694 - protein, 37 aa, Artificial Sequence
  Description of Artificial Sequence: Synthetic polypeptide
DESEIATTNPVATAQWGANTTTSAMNHLAGMPGGSFH

SEQ ID NO: 202695 - protein, 38 aa, Artificial Sequence
  Description of Artificial Sequence: Synthetic polypeptide
DEMEISCTNPVATEQYGQCVCSNWGEPNAEFFISDNQA

SEQ ID NO: 202696 - protein, 36 aa, Artificial Sequence
  Description of Artificial Sequence: Synthetic polypeptide
DEACIRTTNPVSYEPWGKISSCMEDSISDQMNGGNF

SEQ ID NO: 202697 - protein, 38 aa, Artificial Sequence
  Description of Artificial Sequence: Synthetic polypeptide
DEMEISTTNPVAYEQYGQCVCSNWGEHNAENFNSDTQS

SEQ ID NO: 202698 - protein, 38 aa, Artificial Sequence
  Description of Artificial Sequence: Synthetic polypeptide
AEEEISTTNPVATEGYGQCVCSNWGEHNAEGFNSDNQS

SEQ ID NO: 202699 - protein, 35 aa, Artificial Sequence
  Description of Artificial Sequence: Synthetic polypeptide
DESEIRTTNPIATECWGATWSNAIDEAEPKGEPYI

SEQ ID NO: 202700 - protein, 38 aa, Artificial Sequence
  Description of Artificial Sequence: Synthetic polypeptide
AEEEISTTNPVATEGYGQCVCSNWGEHNAEGFNSETQG

SEQ ID NO: 202701 - protein, 39 aa, Artificial Sequence
  Description of Artificial Sequence: Synthetic polypeptide
DEECIGTTNPVATEQYGQCVCSNWGEDHNAENFNSDNQL

SEQ ID NO: 202702 - protein, 38 aa, Artificial Sequence
  Description of Artificial Sequence: Synthetic polypeptide
AEEEISTTNPVATEGYGQCVCSNWGEHNAENFGSETQS

SEQ ID NO: 202703 - protein, 39 aa, Artificial Sequence
  Description of Artificial Sequence: Synthetic polypeptide
DEECIGTTNPVATEQYGQCVCSNWEEDHNIENFNSDPQA

SEQ ID NO: 202704 - protein, 38 aa, Artificial Sequence
  Description of Artificial Sequence: Synthetic polypeptide
DEMEISTTNPVAYEQYGQCVCSNWGEHNAENFNSDNQS

SEQ ID NO: 202705 - protein, 39 aa, Artificial Sequence
  Description of Artificial Sequence: Synthetic polypeptide
DEMEISTTNPVAYEQYGQCVCSNWGEDTNAENFNSETQS

SEQ ID NO: 202706 - protein, 38 aa, Artificial Sequence
  Description of Artificial Sequence: Synthetic polypeptide
DEAEISTTNPVAYEQYGQCVCSWGEDHNAENFNSDTQA

SEQ ID NO: 202707 - protein, 36 aa, Artificial Sequence
  Description of Artificial Sequence: Synthetic polypeptide
DESEIRTTNPIATECWGATVWANCEDWAEPKGEPYI

SEQ ID NO: 202708 - protein, 38 aa, Artificial Sequence
  Description of Artificial Sequence: Synthetic polypeptide
DEECISTTNPVATEQYGQCVCSNWGEHDAENFISDTQS

SEQ ID NO: 202709 - protein, 38 aa, Artificial Sequence
  Description of Artificial Sequence: Synthetic polypeptide
DEVEISTTNPVATEAYGVISVDDLEQIMDGGDDGGEDS

SEQ ID NO: 202710 - protein, 38 aa, Artificial Sequence
  Description of Artificial Sequence: Synthetic polypeptide
AEEEISTTNPVATEGYGQCVCSNWGEHNTENFISDFQA

SEQ ID NO: 202711 - protein, 39 aa, Artificial Sequence
  Description of Artificial Sequence: Synthetic polypeptide
AEEEISTTNPVATEGYGQCVCSTWGEDHNAENFNSETQS

SEQ ID NO: 202712 - protein, 34 aa, Artificial Sequence
  Description of Artificial Sequence: Synthetic polypeptide
DEAEISTTNPVAYESWGCVCIDDQGQPQQDDHTT

SEQ ID NO: 202713 - protein, 38 aa, Artificial Sequence
  Description of Artificial Sequence: Synthetic polypeptide
CEEEIATTNPVATASWGHSVSGTGEAGINPPDGMEKVN

SEQ ID NO: 202714 - protein, 36 aa, Artificial Sequence
  Description of Artificial Sequence: Synthetic polypeptide
DEVENATTNPVAYEQWGSTCSCWINRNDHQGDDDDY

SEQ ID NO: 202715 - protein, 36 aa, Artificial Sequence
  Description of Artificial Sequence: Synthetic polypeptide
DTEAEIRCTNPVSYEPWGKISCMEYSISGQSNGGNT

SEQ ID NO: 202716 - protein, 37 aa, Artificial Sequence
  Description of Artificial Sequence: Synthetic polypeptide
DDAEIRTTNPVAYEQYGCCCSNWGEHNQEHFNSDTQA

SEQ ID NO: 202717 - protein, 37 aa, Artificial Sequence
  Description of Artificial Sequence: Synthetic polypeptide
DDAEIRTTNPVAYEQYGCICSNWGEHNAENFPSDNQA

SEQ ID NO: 202718 - protein, 38 aa, Artificial Sequence
  Description of Artificial Sequence: Synthetic polypeptide
DEMEISTTNPVATCQYGQCVCSNWGEHNAEYFNSDTQS

SEQ ID NO: 202719 - protein, 36 aa, Artificial Sequence
  Description of Artificial Sequence: Synthetic polypeptide
ADNEIACTNPVATEQYGCSCSNWGEDNAYFGSDTQS

SEQ ID NO: 202720 - protein, 35 aa, Artificial Sequence
  Description of Artificial Sequence: Synthetic polypeptide
DESEIRTTNPIATECWGATTWANAETWAEPVGQYI

SEQ ID NO: 202721 - protein, 37 aa, Artificial Sequence
  Description of Artificial Sequence: Synthetic polypeptide
DEMEISTTNPVATEGWGCVCSMWGEENQEYFGSDTQA

SEQ ID NO: 202722 - protein, 38 aa, Artificial Sequence
  Description of Artificial Sequence: Synthetic polypeptide
DDAEIRTTNPVAYEQYGQCVCSNSGEHNAENFNSETQA

SEQ ID NO: 202723 - protein, 38 aa, Artificial Sequence
  Description of Artificial Sequence: Synthetic polypeptide
DDEAISTTNPVATEQYGCVCSNWGEDHNAENFNSDTQA

SEQ ID NO: 202724 - protein, 39 aa, Artificial Sequence
  Description of Artificial Sequence: Synthetic polypeptide
DEECISTTNPVATEQYGQCVCSNWGEGHNAENFNSDTQS

SEQ ID NO: 202725 - protein, 38 aa, Artificial Sequence
  Description of Artificial Sequence: Synthetic polypeptide
DEMEISTTNPVATEGWGCVCSTWGEDENQEYFGSDTQS

SEQ ID NO: 202726 - protein, 39 aa, Artificial Sequence
  Description of Artificial Sequence: Synthetic polypeptide
DEEEISTTNPVAYEGYGICVTSTWGADDNAEYFNSDPQS

SEQ ID NO: 202727 - protein, 37 aa, Artificial Sequence
  Description of Artificial Sequence: Synthetic polypeptide
AENEIACTNPVATEEYGCSCSNWGEDNAEYFGSDNQS

SEQ ID NO: 202728 - protein, 39 aa, Artificial Sequence
  Description of Artificial Sequence: Synthetic polypeptide
DEEEISTTNPVAYEGYGICVTSTWGADHNAENFNSDPQA

SEQ ID NO: 202729 - protein, 37 aa, Artificial Sequence
  Description of Artificial Sequence: Synthetic polypeptide
DEMEISTTNPVATEGWGCVCSWGEDENQEYFNSDTQA

SEQ ID NO: 202730 - protein, 39 aa, Artificial Sequence
  Description of Artificial Sequence: Synthetic polypeptide
DEAEISTTNPVATEQYGQCVCSNWGEDHNEEGFISENQA

SEQ ID NO: 202731 - protein, 39 aa, Artificial Sequence
  Description of Artificial Sequence: Synthetic polypeptide
DDAEIRTTNPVAYEQYGQCVCSNWGEGHNTENFNSDNQA

SEQ ID NO: 202732 - protein, 40 aa, Artificial Sequence
  Description of Artificial Sequence: Synthetic polypeptide
DEEEIRTTNPVATEAYGVVVVTVTTNQAGTEAGTVTEEAE

SEQ ID NO: 202733 - protein, 40 aa, Artificial Sequence
  Description of Artificial Sequence: Synthetic polypeptide
DEEEIRTTNPVATEAYGVVVVTVTTTQAGTEAGTVTQEVE

SEQ ID NO: 202734 - protein, 39 aa, Artificial Sequence
  Description of Artificial Sequence: Synthetic polypeptide
DTAEIRTTNPVATEQYWCSTLAVGGNYDASNMKEGQNND

SEQ ID NO: 202735 - protein, 38 aa, Artificial Sequence
  Description of Artificial Sequence: Synthetic polypeptide
DEEEISTTNPVAYEGYGCVCSNWGEDHNIENFNSDTQS

SEQ ID NO: 202736 - protein, 36 aa, Artificial Sequence
  Description of Artificial Sequence: Synthetic polypeptide
ADNEIACTNPVATEQYGCSCSWMEHNAEYFGSDTQS

SEQ ID NO: 202737 - protein, 38 aa, Artificial Sequence
  Description of Artificial Sequence: Synthetic polypeptide
DEEEISTTNPVAYEGYGCVCSNWGEDHNAEYFNSENQS

SEQ ID NO: 202738 - protein, 37 aa, Artificial Sequence
  Description of Artificial Sequence: Synthetic polypeptide
DEEEISTTNPVAYEGYGCVCGNWGEHNQEYFDSDTQS

SEQ ID NO: 202739 - protein, 36 aa, Artificial Sequence
  Description of Artificial Sequence: Synthetic polypeptide
DTEAEIRCTNPVSYEPWGKISCMEDSQSDQSNGGNT

SEQ ID NO: 202740 - protein, 38 aa, Artificial Sequence
  Description of Artificial Sequence: Synthetic polypeptide
DEEEISTTNPVAYEGYGCVCSNSGEDHNAENFNSDTQA

SEQ ID NO: 202741 - protein, 38 aa, Artificial Sequence
  Description of Artificial Sequence: Synthetic polypeptide
DEEEISTTNPVAYEGYGCVCSNSGEDHNAENFNSDTQN

SEQ ID NO: 202742 - protein, 38 aa, Artificial Sequence
  Description of Artificial Sequence: Synthetic polypeptide
DEEEISTTNPVAYEGYGCVCSNWEEDHNAENFISDNQS

SEQ ID NO: 202743 - protein, 38 aa, Artificial Sequence
  Description of Artificial Sequence: Synthetic polypeptide
DEEEISTTNPVAYEGYGCVCSNWEEDHNAENFNSDNQA

SEQ ID NO: 202744 - protein, 38 aa, Artificial Sequence
  Description of Artificial Sequence: Synthetic polypeptide
DEEEISTTNPVAYEGYGCVCSNWEEDHNAENFNSDNQS

SEQ ID NO: 202745 - protein, 38 aa, Artificial Sequence
  Description of Artificial Sequence: Synthetic polypeptide
DEEEISTTNPVAYEGYGCVCSNWGEDHNAEGFNSETQS

SEQ ID NO: 202746 - protein, 38 aa, Artificial Sequence
  Description of Artificial Sequence: Synthetic polypeptide
DEEEISTTNPVAYEGYGCVCSNWGEDHNAENFNSDFQA

SEQ ID NO: 202747 - protein, 40 aa, Artificial Sequence
  Description of Artificial Sequence: Synthetic polypeptide
DEEEIRTTNPVATEAYGVVVVTVTTNQAGTEAGTVATEVG

SEQ ID NO: 202748 - protein, 37 aa, Artificial Sequence
  Description of Artificial Sequence: Synthetic polypeptide
DEVTIATTNPVATDQYGVVTSTGDEGMGGGQGEEFTD

SEQ ID NO: 202749 - protein, 38 aa, Artificial Sequence
  Description of Artificial Sequence: Synthetic polypeptide
DEEEISTTNPVAYEGYGCVCSNWGEDHNAENFNSDFQS

SEQ ID NO: 202750 - protein, 37 aa, Artificial Sequence
  Description of Artificial Sequence: Synthetic polypeptide
DEVTIGTTNPVATDQYGQVVSTGDEGMGGGQGEEDTD

SEQ ID NO: 202751 - protein, 38 aa, Artificial Sequence
  Description of Artificial Sequence: Synthetic polypeptide
DEEEISTTNPVAYEGYGCVCSNWGEDHNAENFNSDNQS

SEQ ID NO: 202752 - protein, 38 aa, Artificial Sequence
  Description of Artificial Sequence: Synthetic polypeptide
DEEEISTTNPVAYEGYGCVCSNWGEDHNAENFNSDTQA

SEQ ID NO: 202753 - protein, 38 aa, Artificial Sequence
  Description of Artificial Sequence: Synthetic polypeptide
DEVTIGTTNPVATDQYGTVVSATGDEGMGGGQGEENTD

SEQ ID NO: 202754 - protein, 38 aa, Artificial Sequence
  Description of Artificial Sequence: Synthetic polypeptide
DEEEISTTNPVAYEGYGCVCSNWGEDHNAENFNSDTQS

SEQ ID NO: 202755 - protein, 32 aa, Artificial Sequence
  Description of Artificial Sequence: Synthetic polypeptide
QETEIATTNPIATECWGATAAEEDWAEPKGPI

SEQ ID NO: 202756 - protein, 38 aa, Artificial Sequence
  Description of Artificial Sequence: Synthetic polypeptide
DEEEISTTNPVAYEGYGCVCSNWGEDHNAENFNSETQS

SEQ ID NO: 202757 - protein, 37 aa, Artificial Sequence
  Description of Artificial Sequence: Synthetic polypeptide
DEEEISTTNPVAYEGYGCVCGNWGEHNAEFFNSENQA

SEQ ID NO: 202758 - protein, 39 aa, Artificial Sequence
  Description of Artificial Sequence: Synthetic polypeptide
DDEEISTTNPVATEQYGQCVCSNWGEDDNAENFISDNQS

SEQ ID NO: 202759 - protein, 35 aa, Artificial Sequence
  Description of Artificial Sequence: Synthetic polypeptide
CEEVIACTNPVATEQWGCVANMNNSNAAGTPGESW

SEQ ID NO: 202760 - protein, 36 aa, Artificial Sequence
  Description of Artificial Sequence: Synthetic polypeptide
CEEVIACTNPVATEQWGHVVANMNNSNAAGGPGESR

SEQ ID NO: 202761 - protein, 35 aa, Artificial Sequence
  Description of Artificial Sequence: Synthetic polypeptide
DEAEIRTTNPIATECWGATTWANAEDWAEPKGPYI

SEQ ID NO: 202762 - protein, 34 aa, Artificial Sequence
  Description of Artificial Sequence: Synthetic polypeptide
DESEIASTNPIATECWGNTTWANNTWAEPVGQYR

SEQ ID NO: 202763 - protein, 36 aa, Artificial Sequence
  Description of Artificial Sequence: Synthetic polypeptide
SEAEIACTNPVATEQYGCVPGTGVIPEATGDDQPAH

SEQ ID NO: 202764 - protein, 35 aa, Artificial Sequence
  Description of Artificial Sequence: Synthetic polypeptide
DETEIVTTNPIATEQWGATTWANAEDPAEPEGPYI

SEQ ID NO: 202765 - protein, 35 aa, Artificial Sequence
  Description of Artificial Sequence: Synthetic polypeptide
DTTEIRTTNPIATECWGATTSANATDWMEPKGPYI

SEQ ID NO: 202766 - protein, 35 aa, Artificial Sequence
  Description of Artificial Sequence: Synthetic polypeptide
DETEIVTTNPIATEQWGATTWANAEDWAEPEGPYI

SEQ ID NO: 202767 - protein, 38 aa, Artificial Sequence
  Description of Artificial Sequence: Synthetic polypeptide
DESEIATTNPVAYEQWGSTVTNDRNNPNTNDANGQKGE

SEQ ID NO: 202768 - protein, 35 aa, Artificial Sequence
  Description of Artificial Sequence: Synthetic polypeptide
DTTEIACTNPVATASWGCVAGNNNLQEDAGGGKHQ

SEQ ID NO: 202769 - protein, 35 aa, Artificial Sequence
  Description of Artificial Sequence: Synthetic polypeptide
DEAEIRTTNPIATECWGATTWANAADWAEPKGPYI

SEQ ID NO: 202770 - protein, 36 aa, Artificial Sequence
  Description of Artificial Sequence: Synthetic polypeptide
DTTAEIACTNPVAYEQWGSVCAMANNQDAVGIDQVV

SEQ ID NO: 202771 - protein, 38 aa, Artificial Sequence
  Description of Artificial Sequence: Synthetic polypeptide
QESEIATTNPVATEQYGNISFWAPEDTLREPHEGEDTR

SEQ ID NO: 202772 - protein, 35 aa, Artificial Sequence
  Description of Artificial Sequence: Synthetic polypeptide
DTSEVACTNPVSTEGYGNVCYNTIDQDRHGMQGQH

SEQ ID NO: 202773 - protein, 36 aa, Artificial Sequence
  Description of Artificial Sequence: Synthetic polypeptide
DEMAIGTTNPVATEQYGCSCTATDGSPVEFETSDKG

SEQ ID NO: 202774 - protein, 35 aa, Artificial Sequence
  Description of Artificial Sequence: Synthetic polypeptide
DTSEVACTNPVSTEGYGNVCYNTIDQDRHGMQDDM

SEQ ID NO: 202775 - protein, 39 aa, Artificial Sequence
  Description of Artificial Sequence: Synthetic polypeptide
SEGEIATTNPVATEQYGNISFSAPFDTLREPHEGMQDTR

SEQ ID NO: 202776 - protein, 37 aa, Artificial Sequence
  Description of Artificial Sequence: Synthetic polypeptide
SEAEIACTNPVATEQYGCVAGNGVADEAGTPPDNNHK

SEQ ID NO: 202777 - protein, 37 aa, Artificial Sequence
  Description of Artificial Sequence: Synthetic polypeptide
SEGEIATTNPVATAQWGHSASAVGDQEADTPGGEDNI

SEQ ID NO: 202778 - protein, 37 aa, Artificial Sequence
  Description of Artificial Sequence: Synthetic polypeptide
DEQEIATTNPVAYEQWGHCVFAANTGGLEAIANPDEH

SEQ ID NO: 202779 - protein, 38 aa, Artificial Sequence
  Description of Artificial Sequence: Synthetic polypeptide
QEEEIATTNPVATEQWGTNVCAGTAAETQNHQDDPTDQ

SEQ ID NO: 202780 - protein, 35 aa, Artificial Sequence
  Description of Artificial Sequence: Synthetic polypeptide
DETEIVTTNPVATECWGATTWANAEDWAEPKGPYI

SEQ ID NO: 202781 - protein, 34 aa, Artificial Sequence
  Description of Artificial Sequence: Synthetic polypeptide
AEMEIACTNPCSYEQYGCVCSMWEDNQSFGSEQS

SEQ ID NO: 202782 - protein, 38 aa, Artificial Sequence
  Description of Artificial Sequence: Synthetic polypeptide
CEEEIACTNPVATEQYGSCAAMPGNGGPPAAGNPIEVV

SEQ ID NO: 202783 - protein, 38 aa, Artificial Sequence
  Description of Artificial Sequence: Synthetic polypeptide
AEMCISTTNPVATEQYGQCVTSTWGADNAEYFNSDPQS

SEQ ID NO: 202784 - protein, 39 aa, Artificial Sequence
  Description of Artificial Sequence: Synthetic polypeptide
DECEICTTNPVATEAYGVVVNNTQLQAGTEQGTTTQDEE

SEQ ID NO: 202785 - protein, 35 aa, Artificial Sequence
  Description of Artificial Sequence: Synthetic polypeptide
AECENATTNPVAYESWGVVATAGGNTGNAGNDNQN

SEQ ID NO: 202786 - protein, 35 aa, Artificial Sequence
  Description of Artificial Sequence: Synthetic polypeptide
AECQEIATTNPVAYEPWGVVCSTWEHGDIQGQTDH

SEQ ID NO: 202787 - protein, 38 aa, Artificial Sequence
  Description of Artificial Sequence: Synthetic polypeptide
DDEEISTTNPVATEQYGCVCSMWGEDHNAENFISDTQA

SEQ ID NO: 202788 - protein, 37 aa, Artificial Sequence
  Description of Artificial Sequence: Synthetic polypeptide
ESEAEIRTTNPVAYEQWGVVYQWGTNPPGEKDDGTTQ

SEQ ID NO: 202789 - protein, 39 aa, Artificial Sequence
  Description of Artificial Sequence: Synthetic polypeptide
DEEEISTTNPVATEQYGQCVCSNWGEDHNQENFSSDTQQ

SEQ ID NO: 202790 - protein, 39 aa, Artificial Sequence
  Description of Artificial Sequence: Synthetic polypeptide
DECEICTTNPVATEAYGVVVNSTQQQNATEQGTTTQEEE

SEQ ID NO: 202791 - protein, 36 aa, Artificial Sequence
  Description of Artificial Sequence: Synthetic polypeptide
DAEEIATTNPVAYEQWGCNTAGNNGTTTAEGGNLDF

SEQ ID NO: 202792 - protein, 39 aa, Artificial Sequence
  Description of Artificial Sequence: Synthetic polypeptide
DEEEISTTNPVATEQYGQCVCSNWGEDHNQENSISDTQL

SEQ ID NO: 202793 - protein, 37 aa, Artificial Sequence
  Description of Artificial Sequence: Synthetic polypeptide
ESEAEIRTTNPVAYEQWGVVYQWGTNPPGEKGDGTGK

SEQ ID NO: 202794 - protein, 38 aa, Artificial Sequence
  Description of Artificial Sequence: Synthetic polypeptide
DEECISTTNPVAYEGYGQCVCSNWGEHNAENFGSENQS

SEQ ID NO: 202795 - protein, 40 aa, Artificial Sequence
  Description of Artificial Sequence: Synthetic polypeptide
DECEICTTNPVATEAYGVVVVNSTQLQAGTEQGSTTTDEE

SEQ ID NO: 202796 - protein, 37 aa, Artificial Sequence
  Description of Artificial Sequence: Synthetic polypeptide
ESEAEIRTTNPVAYEQWGVVYQWGTNPPGEKPDGSGE

SEQ ID NO: 202797 - protein, 39 aa, Artificial Sequence
  Description of Artificial Sequence: Synthetic polypeptide
DEEEIRTTNPVATEGYGQCTCSMWEEDDNAEYFGSDTQA

SEQ ID NO: 202798 - protein, 39 aa, Artificial Sequence
  Description of Artificial Sequence: Synthetic polypeptide
DEAEIACTNPVATEQYGSVACSPVGDDHHQIDHSDGEAP

SEQ ID NO: 202799 - protein, 37 aa, Artificial Sequence
  Description of Artificial Sequence: Synthetic polypeptide
DEATEIASTNPVAYEQWGSVVCGNAQLDHVDTSRDDQ

SEQ ID NO: 202800 - protein, 37 aa, Artificial Sequence
  Description of Artificial Sequence: Synthetic polypeptide
DEGEIACTNPVAYEQYGSACSVAPHLNNEAPIGEAVN

SEQ ID NO: 202801 - protein, 36 aa, Artificial Sequence
  Description of Artificial Sequence: Synthetic polypeptide
CEEEIACTNPVATEQWGCVAGNNNGNPNAATEGMED

SEQ ID NO: 202802 - protein, 35 aa, Artificial Sequence
  Description of Artificial Sequence: Synthetic polypeptide
GTEAEIATTNPVAYEAWGNICATTDNQGIEDRGTH

SEQ ID NO: 202803 - protein, 38 aa, Artificial Sequence
  Description of Artificial Sequence: Synthetic polypeptide
DTNEIRTTNPVATEQYGTLSFTCDYSEPVTTEVHEDHE

SEQ ID NO: 202804 - protein, 36 aa, Artificial Sequence
  Description of Artificial Sequence: Synthetic polypeptide
GTEAEIATTNPVAYEAWGNICATTDNQGDTDRGQRH

SEQ ID NO: 202805 - protein, 37 aa, Artificial Sequence
  Description of Artificial Sequence: Synthetic polypeptide
DEGEIACTNPVATEQYGSACAANPAEGQDHQDDSMAE

SEQ ID NO: 202806 - protein, 37 aa, Artificial Sequence
  Description of Artificial Sequence: Synthetic polypeptide
AEMEIACTNPVATEQYGCVCSNWGEHNAEHFISENQS

SEQ ID NO: 202807 - protein, 38 aa, Artificial Sequence
  Description of Artificial Sequence: Synthetic polypeptide
DEGEIACTNPVATEQYGSACAAINPPEEAGAEQDNDAM

SEQ ID NO: 202808 - protein, 38 aa, Artificial Sequence
  Description of Artificial Sequence: Synthetic polypeptide
AEEEISTTNPVATEQYGQCVCSNWMEHNEENFISDTQA

SEQ ID NO: 202809 - protein, 35 aa, Artificial Sequence
  Description of Artificial Sequence: Synthetic polypeptide
DEAEIRTTNPIATECWGATTWANAEDWAEPKGPYM

SEQ ID NO: 202810 - protein, 35 aa, Artificial Sequence
  Description of Artificial Sequence: Synthetic polypeptide
DEAEIRTTNPIATECWGATTWANAEDWKEPQGPQI

SEQ ID NO: 202811 - protein, 35 aa, Artificial Sequence
  Description of Artificial Sequence: Synthetic polypeptide
DEAEIRTTNPIATECWGATTWANAKDWAEPKGPYI

SEQ ID NO: 202812 - protein, 37 aa, Artificial Sequence
  Description of Artificial Sequence: Synthetic polypeptide
CEEEIACTNPVAYEQWGHCFVATGELAEIGNSDEKAM

SEQ ID NO: 202813 - protein, 34 aa, Artificial Sequence
  Description of Artificial Sequence: Synthetic polypeptide
GNTEIATTNPVAYESWGCVCTIDSNDRNDQQNEN

SEQ ID NO: 202814 - protein, 35 aa, Artificial Sequence
  Description of Artificial Sequence: Synthetic polypeptide
DETEVASTNPIATEGWGNTVWAANEDIQERVGPYI

SEQ ID NO: 202815 - protein, 36 aa, Artificial Sequence
  Description of Artificial Sequence: Synthetic polypeptide
AEAEIAPTNPCSYEQYGVTVSCLNMLSQGVGGTPPF

SEQ ID NO: 202816 - protein, 37 aa, Artificial Sequence
  Description of Artificial Sequence: Synthetic polypeptide
CEDEIRSTNPVATEFYGVVNDIGNDLENAEMGGDGGQ

SEQ ID NO: 202817 - protein, 37 aa, Artificial Sequence
  Description of Artificial Sequence: Synthetic polypeptide
CEDEIRSTNPVATEFYGVVNDLGNDLENAEEENGGGQ

SEQ ID NO: 202818 - protein, 38 aa, Artificial Sequence
  Description of Artificial Sequence: Synthetic polypeptide
DEASIACTNPVATEQYGSTACAGANPGLPLGSAEGNHA

SEQ ID NO: 202819 - protein, 37 aa, Artificial Sequence
  Description of Artificial Sequence: Synthetic polypeptide
SEAEAEIATTNPVAYEPWGAVCIENHMEQNQNGDNNM

SEQ ID NO: 202820 - protein, 34 aa, Artificial Sequence
  Description of Artificial Sequence: Synthetic polypeptide
DETHIRTTNPIATECWGATTANAEDWAEPKGPYI

SEQ ID NO: 202821 - protein, 39 aa, Artificial Sequence
  Description of Artificial Sequence: Synthetic polypeptide
SEEEIHTTNPVATEGYGMVDNGQGTNFDQEGGGGEQFGD

SEQ ID NO: 202822 - protein, 35 aa, Artificial Sequence
  Description of Artificial Sequence: Synthetic polypeptide
DETIIRTTNPIATECWGVTTWANAEDWAEPKGPYI

SEQ ID NO: 202823 - protein, 35 aa, Artificial Sequence
  Description of Artificial Sequence: Synthetic polypeptide
DEASIATTNPIATEAWGSIVPTWWDQHEHDQHTKP

SEQ ID NO: 202824 - protein, 36 aa, Artificial Sequence
  Description of Artificial Sequence: Synthetic polypeptide
ETEEIATTNPVAYEQWGCVYNNVVRPEDVQKVHNAS

SEQ ID NO: 202825 - protein, 37 aa, Artificial Sequence
  Description of Artificial Sequence: Synthetic polypeptide
GSAEIRTTNPVATEQYGVCICPLPNEEQYEYGEEEHQ

SEQ ID NO: 202826 - protein, 36 aa, Artificial Sequence
  Description of Artificial Sequence: Synthetic polypeptide
AEMEIACTNPVATEQYGCSCSNWGEDNAYFNSDTQS

SEQ ID NO: 202827 - protein, 38 aa, Artificial Sequence
  Description of Artificial Sequence: Synthetic polypeptide
DEGEIACTNPVATEQYGSCAAAPGLHPMAGMEIGNENT

SEQ ID NO: 202828 - protein, 37 aa, Artificial Sequence
  Description of Artificial Sequence: Synthetic polypeptide
DEGEIACTNPVATEQYGSCAAAGDPIGNNHADEMNDW

SEQ ID NO: 202829 - protein, 40 aa, Artificial Sequence
  Description of Artificial Sequence: Synthetic polypeptide
DEEEIRTTNPVATWQYGTVAARSFELANIIEDTSTAQNYE

SEQ ID NO: 202830 - protein, 35 aa, Artificial Sequence
  Description of Artificial Sequence: Synthetic polypeptide
DTNEIATTNPTAYEQWGATYYSIEIEMNQREMDDR

SEQ ID NO: 202831 - protein, 36 aa, Artificial Sequence
  Description of Artificial Sequence: Synthetic polypeptide
GTEAEIATTNPVAYEAWGNICATTDNQGDENRGNTH

SEQ ID NO: 202832 - protein, 37 aa, Artificial Sequence
  Description of Artificial Sequence: Synthetic polypeptide
ADEEISCTNPVATEQYGCVCSWGEDHNAENSGSQTQA

SEQ ID NO: 202833 - protein, 36 aa, Artificial Sequence
  Description of Artificial Sequence: Synthetic polypeptide
SEAEIACTNPVATEQWGCTAATNNQEAPMAQMGDAM

SEQ ID NO: 202834 - protein, 36 aa, Artificial Sequence
  Description of Artificial Sequence: Synthetic polypeptide
GTEAEIATTNPVAYEAWGNICATTDNQGDEDRGNEG

SEQ ID NO: 202835 - protein, 34 aa, Artificial Sequence
  Description of Artificial Sequence: Synthetic polypeptide
SEAEIACTNPVATEQWGCNTAGNGDAEAGIDEAM

SEQ ID NO: 202836 - protein, 37 aa, Artificial Sequence
  Description of Artificial Sequence: Synthetic polypeptide
SEEVIRTTNPVAYEPWGQKVVPYYQMNAGAGTVENRH

SEQ ID NO: 202837 - protein, 37 aa, Artificial Sequence
  Description of Artificial Sequence: Synthetic polypeptide
SEEVIRTTNPVAYEPWGQKVVPWEMNAGLGTVENMRT

SEQ ID NO: 202838 - protein, 37 aa, Artificial Sequence
  Description of Artificial Sequence: Synthetic polypeptide
SEEVIRTTNPVAYEPWGQKVVPFEMNAGELGTVENRE

SEQ ID NO: 202839 - protein, 37 aa, Artificial Sequence
  Description of Artificial Sequence: Synthetic polypeptide
SEEVIRTTNPVAYEPWGCKVVPYYEMNAGLGTVENRT

SEQ ID NO: 202840 - protein, 35 aa, Artificial Sequence
  Description of Artificial Sequence: Synthetic polypeptide
GTEAEIATTNPVAYEAWGNICATTDNQGDEDRGEK

SEQ ID NO: 202841 - protein, 37 aa, Artificial Sequence
  Description of Artificial Sequence: Synthetic polypeptide
DEESIATTNPVAYEPQWGHSACAAANGDATQAGDQSQ

SEQ ID NO: 202842 - protein, 37 aa, Artificial Sequence
  Description of Artificial Sequence: Synthetic polypeptide
DTGEIATTNPVAYEQWGHCVFAANTGGLEAIANPDRM

SEQ ID NO: 202843 - protein, 37 aa, Artificial Sequence
  Description of Artificial Sequence: Synthetic polypeptide
SEAEIACTNPVATAQWGGCVAGTGMQLGQHGDDNQPH

SEQ ID NO: 202844 - protein, 36 aa, Artificial Sequence
  Description of Artificial Sequence: Synthetic polypeptide
SEAEIACTNPVATAQWGGCTVAGTGMLGAHGDDNPH

SEQ ID NO: 202845 - protein, 35 aa, Artificial Sequence
  Description of Artificial Sequence: Synthetic polypeptide
SEAEIACTNPVATAAWGGCVAGTGMLGQHGDDPPH

SEQ ID NO: 202846 - protein, 39 aa, Artificial Sequence
  Description of Artificial Sequence: Synthetic polypeptide
DEEEISTTNPVATEQYGQCVCSNWGEDHNQENFSSDTQD

SEQ ID NO: 202847 - protein, 36 aa, Artificial Sequence
  Description of Artificial Sequence: Synthetic polypeptide
DEGEIACTNPVATEQWGANCAQNPVNNTAGNPTGSL

SEQ ID NO: 202848 - protein, 35 aa, Artificial Sequence
  Description of Artificial Sequence: Synthetic polypeptide
DEAEIRTTNPIATECWGATTFANAEDWAEPKGPYI

SEQ ID NO: 202849 - protein, 36 aa, Artificial Sequence
  Description of Artificial Sequence: Synthetic polypeptide
ESEAEIATTNPVAYEQWGVVYQWGTNPPGEKGDQST

SEQ ID NO: 202850 - protein, 38 aa, Artificial Sequence
  Description of Artificial Sequence: Synthetic polypeptide
DDEEISTTNPVATEGYGQCVCSNWGEHNAENSNSDTQS

SEQ ID NO: 202851 - protein, 38 aa, Artificial Sequence
  Description of Artificial Sequence: Synthetic polypeptide
DDEEISTTNPVATEGYGQCVCSNWGEHNAESFNSDTQG

SEQ ID NO: 202852 - protein, 38 aa, Artificial Sequence
  Description of Artificial Sequence: Synthetic polypeptide
DDEEISTTNPVATEGYGQCVCSNWGEHNQENFNSDTQS

SEQ ID NO: 202853 - protein, 39 aa, Artificial Sequence
  Description of Artificial Sequence: Synthetic polypeptide
DDEEISTTNPVATEGYGQCVCSNWGELHNAEGFNSDNQS

SEQ ID NO: 202854 - protein, 34 aa, Artificial Sequence
  Description of Artificial Sequence: Synthetic polypeptide
SEMEIACTNPCSYEQYGCVCSWGEDQSFGSQTQA

SEQ ID NO: 202855 - protein, 34 aa, Artificial Sequence
  Description of Artificial Sequence: Synthetic polypeptide
SEMEIACTNPCSYEQYGCVCSWGEDNQYFGSDQS

SEQ ID NO: 202856 - protein, 35 aa, Artificial Sequence
  Description of Artificial Sequence: Synthetic polypeptide
SEMEIACTNPCSYEQYGCVCSWGEDLNQSFGSDQM

SEQ ID NO: 202857 - protein, 35 aa, Artificial Sequence
  Description of Artificial Sequence: Synthetic polypeptide
SEAEIASTNPVGYEAYGQVVMAYSPGLSQTVGAIT

SEQ ID NO: 202858 - protein, 35 aa, Artificial Sequence
  Description of Artificial Sequence: Synthetic polypeptide
SEMEIACTNPCSYEQYGCVCSWGELHNQSFGSDQI

SEQ ID NO: 202859 - protein, 36 aa, Artificial Sequence
  Description of Artificial Sequence: Synthetic polypeptide
DEQEIATTNPVAYEQWGCTAGNNALTQATPDDEMTA

SEQ ID NO: 202860 - protein, 35 aa, Artificial Sequence
  Description of Artificial Sequence: Synthetic polypeptide
DETEIRTTNPVSTECWGATVWAAAEDWAEPKGPYI

SEQ ID NO: 202861 - protein, 33 aa, Artificial Sequence
  Description of Artificial Sequence: Synthetic polypeptide
SEMEIACTNPCSYEQYGCVCSWEHTESFGSDQS

SEQ ID NO: 202862 - protein, 35 aa, Artificial Sequence
  Description of Artificial Sequence: Synthetic polypeptide
SEMEIACTNPCSYEQYGCVCSWEHNQESFGSDNQF

SEQ ID NO: 202863 - protein, 34 aa, Artificial Sequence
  Description of Artificial Sequence: Synthetic polypeptide
SEMEIACTNPCSYEQYGCVCSWEELNASFGSDQS

SEQ ID NO: 202864 - protein, 33 aa, Artificial Sequence
  Description of Artificial Sequence: Synthetic polypeptide
SEMEIACTNPCSYEQYGCVCSWEDNQSFISEQS

SEQ ID NO: 202865 - protein, 34 aa, Artificial Sequence
  Description of Artificial Sequence: Synthetic polypeptide
SEMEIACTNPCSYEQYGCVCSWEDNQNFGSDTQA

SEQ ID NO: 202866 - protein, 35 aa, Artificial Sequence
  Description of Artificial Sequence: Synthetic polypeptide
SEAEIASTNPVGYEAYGQVVMAYSPGALSQHVGAL

SEQ ID NO: 202867 - protein, 35 aa, Artificial Sequence
  Description of Artificial Sequence: Synthetic polypeptide
SEMEIACTNPCSYEQYGCVCSWEDNQEYFGSDNQS

SEQ ID NO: 202868 - protein, 35 aa, Artificial Sequence
  Description of Artificial Sequence: Synthetic polypeptide
SEMEIACTNPCSYEQYGCVCSWGALNQESFNSDQA

SEQ ID NO: 202869 - protein, 36 aa, Artificial Sequence
  Description of Artificial Sequence: Synthetic polypeptide
DEQEIATTNPVAYEQWGCTAGNNALTTATPDGDMTE

SEQ ID NO: 202870 - protein, 35 aa, Artificial Sequence
  Description of Artificial Sequence: Synthetic polypeptide
SEMEIACTNPCSYEQYGCVCSWGELNQESFGSDQN

SEQ ID NO: 202871 - protein, 35 aa, Artificial Sequence
  Description of Artificial Sequence: Synthetic polypeptide
DETEIRTTNPVSTECWGATVWAAAEDIAEPKGPYI

SEQ ID NO: 202872 - protein, 38 aa, Artificial Sequence
  Description of Artificial Sequence: Synthetic polypeptide
DDEEISTTNPVATEGYGQCVCSNWGEDNQENFNSDTQA

SEQ ID NO: 202873 - protein, 39 aa, Artificial Sequence
  Description of Artificial Sequence: Synthetic polypeptide
DDEEISTTNPVATEGYGQCVCSNWGEDTNAENFNSDTQS

SEQ ID NO: 202874 - protein, 35 aa, Artificial Sequence
  Description of Artificial Sequence: Synthetic polypeptide
DEMAIGTTNPVATEQYGCLCTATDGWPVEEEIDKQ

SEQ ID NO: 202875 - protein, 35 aa, Artificial Sequence
  Description of Artificial Sequence: Synthetic polypeptide
SEMEIACTNPCSYEQYGQCVCSWNDHNQSFGSDQS

SEQ ID NO: 202876 - protein, 38 aa, Artificial Sequence
  Description of Artificial Sequence: Synthetic polypeptide
DDEEISTTNPVATEGYGQCVCSNWGEHNAEGFNSETQA

SEQ ID NO: 202877 - protein, 38 aa, Artificial Sequence
  Description of Artificial Sequence: Synthetic polypeptide
DDEEISTTNPVATEGYGQCVCSNWGEHNAENFISDNQA

SEQ ID NO: 202878 - protein, 39 aa, Artificial Sequence
  Description of Artificial Sequence: Synthetic polypeptide
DEAEISTTNPVATEGYGQCVCSNWGEDTNAENFISENQS

SEQ ID NO: 202879 - protein, 37 aa, Artificial Sequence
  Description of Artificial Sequence: Synthetic polypeptide
DEECISTTNPVATEGYGCTCSNWGEHNAENFNSDTQA

SEQ ID NO: 202880 - protein, 38 aa, Artificial Sequence
  Description of Artificial Sequence: Synthetic polypeptide
DDEEISTTNPVATEGYGQCVCSNWGEHNAENFNSETQS

SEQ ID NO: 202881 - protein, 36 aa, Artificial Sequence
  Description of Artificial Sequence: Synthetic polypeptide
HEEEISTTNPVATMQWGCIIPNCIVNMDSTDGGNNG

SEQ ID NO: 202882 - protein, 36 aa, Artificial Sequence
  Description of Artificial Sequence: Synthetic polypeptide
HEEEISTTNPVATMQWGCIIPNCIGNMDSTDGGNGE

SEQ ID NO: 202883 - protein, 34 aa, Artificial Sequence
  Description of Artificial Sequence: Synthetic polypeptide
SEMEIACTNPCSYEQYGCVCSWPDQESFGSDTQS

SEQ ID NO: 202884 - protein, 38 aa, Artificial Sequence
  Description of Artificial Sequence: Synthetic polypeptide
DEAEISTTNPVATEGYGQCVCSNWGEHNAENFNSDNQA

SEQ ID NO: 202885 - protein, 35 aa, Artificial Sequence
  Description of Artificial Sequence: Synthetic polypeptide
HEEEISTTNPCATMQWGCTIPNCINMDSTDPGGNH

SEQ ID NO: 202886 - protein, 34 aa, Artificial Sequence
  Description of Artificial Sequence: Synthetic polypeptide
HEEEISATNPVATMRWGTIIPNCINMDSTDGGNN

SEQ ID NO: 202887 - protein, 38 aa, Artificial Sequence
  Description of Artificial Sequence: Synthetic polypeptide
AEEEIRTTNPVATEQYGYFHNTGHISDDNQAEHETEQQ

SEQ ID NO: 202888 - protein, 34 aa, Artificial Sequence
  Description of Artificial Sequence: Synthetic polypeptide
SEMEIACTNPCSYEQYGCVCSWNHNISFGSETQS

SEQ ID NO: 202889 - protein, 38 aa, Artificial Sequence
  Description of Artificial Sequence: Synthetic polypeptide
DDEEISTTNPVATEGYGQCVCSNWGEHNAENFNSDTQA

SEQ ID NO: 202890 - protein, 35 aa, Artificial Sequence
  Description of Artificial Sequence: Synthetic polypeptide
HEEEISTTNPVATMQWGCIIPNCINMDSTDEGGTG

SEQ ID NO: 202891 - protein, 36 aa, Artificial Sequence
  Description of Artificial Sequence: Synthetic polypeptide
DEQEIATTNPVAYEQWGCTAGNNALTTATPDGKDTQ

SEQ ID NO: 202892 - protein, 34 aa, Artificial Sequence
  Description of Artificial Sequence: Synthetic polypeptide
SEAEIASTNPVGYEAYGQVVMAYIPGLSQHVGAN

SEQ ID NO: 202893 - protein, 37 aa, Artificial Sequence
  Description of Artificial Sequence: Synthetic polypeptide
DEECISTTNPVATEGYGCVCGNWGEHNAEYFGSDTQS

SEQ ID NO: 202894 - protein, 37 aa, Artificial Sequence
  Description of Artificial Sequence: Synthetic polypeptide
DEMCISCTNPVATEQYGCVCSNWGEPNAEFFNSDTQA

SEQ ID NO: 202895 - protein, 39 aa, Artificial Sequence
  Description of Artificial Sequence: Synthetic polypeptide
DEEEIRTTNPVATEQYGAFYCNWPEPPGLDDAPEKDIEG

SEQ ID NO: 202896 - protein, 38 aa, Artificial Sequence
  Description of Artificial Sequence: Synthetic polypeptide
DDEEISTTNPVATEQWGQCVTSNSGEDNAENFGSDTAS

SEQ ID NO: 202897 - protein, 36 aa, Artificial Sequence
  Description of Artificial Sequence: Synthetic polypeptide
CEEEIATTNPVATAQWGGCCAGTFAGLEATANQEFT

SEQ ID NO: 202898 - protein, 37 aa, Artificial Sequence
  Description of Artificial Sequence: Synthetic polypeptide
DEQEIATTNPVAYEQWGHCIVAAASGLEDMNPENDNH

SEQ ID NO: 202899 - protein, 37 aa, Artificial Sequence
  Description of Artificial Sequence: Synthetic polypeptide
DEQEIATTNPVAYEQWGHCIVAAASGLEDMNPTDDRD

SEQ ID NO: 202900 - protein, 38 aa, Artificial Sequence
  Description of Artificial Sequence: Synthetic polypeptide
DEECISTTNPVAYEGYGQCVTSTWGAHNAENFGSDPQA

SEQ ID NO: 202901 - protein, 39 aa, Artificial Sequence
  Description of Artificial Sequence: Synthetic polypeptide
DDEEISTTNPVATEQYGCAVCSNWGEDHNAENFNSDTQS

SEQ ID NO: 202902 - protein, 37 aa, Artificial Sequence
  Description of Artificial Sequence: Synthetic polypeptide
SEAEIACTNPVAYEQYGSVAACPNQLATLTNGGSVHG

SEQ ID NO: 202903 - protein, 40 aa, Artificial Sequence
  Description of Artificial Sequence: Synthetic polypeptide
DECEICTTNPVATEAYGSVSVTSTQQQNATEQGTTTQEEE

SEQ ID NO: 202904 - protein, 38 aa, Artificial Sequence
  Description of Artificial Sequence: Synthetic polypeptide
DECEICTTNPVATEAYGVVATTQQQNATEQGTTTDEEE

SEQ ID NO: 202905 - protein, 37 aa, Artificial Sequence
  Description of Artificial Sequence: Synthetic polypeptide
DEQEIATTNPVAYEQWGHCIVAAASGLEEMNPTGDRH

SEQ ID NO: 202906 - protein, 39 aa, Artificial Sequence
  Description of Artificial Sequence: Synthetic polypeptide
CEEEISTTNPVATEQYGQCVCSNWGEWHNAEHFNSDTQD

SEQ ID NO: 202907 - protein, 35 aa, Artificial Sequence
  Description of Artificial Sequence: Synthetic polypeptide
DETEIRTVNPIATECWGVTTWSNAEDWAEPKGPYI

SEQ ID NO: 202908 - protein, 39 aa, Artificial Sequence
  Description of Artificial Sequence: Synthetic polypeptide
DEEEISTTNPVATEQYGQCVCSNWGEDHNQENFISDTQS

SEQ ID NO: 202909 - protein, 36 aa, Artificial Sequence
  Description of Artificial Sequence: Synthetic polypeptide
EAEEIATTNPVAYEQWGCNTAGNNGLTEAEGGNLDS

SEQ ID NO: 202910 - protein, 38 aa, Artificial Sequence
  Description of Artificial Sequence: Synthetic polypeptide
DDECISTTNPVATEQYGQCVCSTWGEHNAENFSSDTQS

SEQ ID NO: 202911 - protein, 37 aa, Artificial Sequence
  Description of Artificial Sequence: Synthetic polypeptide
DDECISTTNPVATEQYGQCVCSWGEHNQENFISEFQS

SEQ ID NO: 202912 - protein, 38 aa, Artificial Sequence
  Description of Artificial Sequence: Synthetic polypeptide
DDEEISTTNPVATEQYGCVCQNWGEDHNAENFNSDTQA

SEQ ID NO: 202913 - protein, 38 aa, Artificial Sequence
  Description of Artificial Sequence: Synthetic polypeptide
CEEEIATTNPVATAQWGCNVSSTGEAGINPRDGMEKVP

SEQ ID NO: 202914 - protein, 35 aa, Artificial Sequence
  Description of Artificial Sequence: Synthetic polypeptide
DECEIRTTNPIATECWGAMTWANAEDWAEPKGPYI

SEQ ID NO: 202915 - protein, 35 aa, Artificial Sequence
  Description of Artificial Sequence: Synthetic polypeptide
DECEIRTTNPIATECWGATTWANACDWAEPKGPYI

SEQ ID NO: 202916 - protein, 39 aa, Artificial Sequence
  Description of Artificial Sequence: Synthetic polypeptide
DDECIRTTNPVATEQYGQCVCSNWGEDHNAEFFNSDNQG

SEQ ID NO: 202917 - protein, 39 aa, Artificial Sequence
  Description of Artificial Sequence: Synthetic polypeptide
DENEIRTTNPVATEIFGCAVTWSNSVPNTHEGDNNQYYF

SEQ ID NO: 202918 - protein, 35 aa, Artificial Sequence
  Description of Artificial Sequence: Synthetic polypeptide
SEMEIACTNPCSYEQYGCVCSTWGEDNQSFNSDQS

SEQ ID NO: 202919 - protein, 38 aa, Artificial Sequence
  Description of Artificial Sequence: Synthetic polypeptide
DEAEISTTNPVATEGYGQCVCSNWGEHNAENFNSDTQA

SEQ ID NO: 202920 - protein, 35 aa, Artificial Sequence
  Description of Artificial Sequence: Synthetic polypeptide
SEMEIACTNPCSYEQYGCVCSNWNHNQSFNSDTQA

SEQ ID NO: 202921 - protein, 39 aa, Artificial Sequence
  Description of Artificial Sequence: Synthetic polypeptide
DDECIRTTNPVATEQYGQCVCSNSGEDHNAENFNSDTQS

SEQ ID NO: 202922 - protein, 35 aa, Artificial Sequence
  Description of Artificial Sequence: Synthetic polypeptide
AEAEIASTNPVGYEAYGQVVMAYSPGLSQHVGEDI

SEQ ID NO: 202923 - protein, 37 aa, Artificial Sequence
  Description of Artificial Sequence: Synthetic polypeptide
SEAEIACTNPVAYMQYGSVAAITNPPEAPGAQTEGTD

SEQ ID NO: 202924 - protein, 38 aa, Artificial Sequence
  Description of Artificial Sequence: Synthetic polypeptide
SEEEIATTNPVAYEQYGCSCPTWGEDDNQEHFSSENQA

SEQ ID NO: 202925 - protein, 36 aa, Artificial Sequence
  Description of Artificial Sequence: Synthetic polypeptide
DEQEIATTNPVAYEQWGHCIIFAGNSGLVDNDGGDQ

SEQ ID NO: 202926 - protein, 35 aa, Artificial Sequence
  Description of Artificial Sequence: Synthetic polypeptide
DECEIRTTNPIATEGWGATTWANAEDWAEPKGPYI

SEQ ID NO: 202927 - protein, 35 aa, Artificial Sequence
  Description of Artificial Sequence: Synthetic polypeptide
DECEIRTTNPIATECWGATTWATAEDWAEPKGPYI

SEQ ID NO: 202928 - protein, 35 aa, Artificial Sequence
  Description of Artificial Sequence: Synthetic polypeptide
DECEIRTTNPIATECWGATTWANKEDWAEPKGPYI

SEQ ID NO: 202929 - protein, 35 aa, Artificial Sequence
  Description of Artificial Sequence: Synthetic polypeptide
DECEIRTTNPIATECWGATTWANAEDWVEPKGPYI

SEQ ID NO: 202930 - protein, 36 aa, Artificial Sequence
  Description of Artificial Sequence: Synthetic polypeptide
SEMEIACTNPCSYEQYGCVCSMWGNLNQESFGSDQA

SEQ ID NO: 202931 - protein, 34 aa, Artificial Sequence
  Description of Artificial Sequence: Synthetic polypeptide
SEMEIACTNPCSYEQYGCVCSMWEPNQSFGSDQA

SEQ ID NO: 202932 - protein, 37 aa, Artificial Sequence
  Description of Artificial Sequence: Synthetic polypeptide
DEEEIATTNPVAYEQYTCTIPNPNVGPQELSINEQTS

SEQ ID NO: 202933 - protein, 35 aa, Artificial Sequence
  Description of Artificial Sequence: Synthetic polypeptide
DECEIRTTNPIATECWGATTWANAEDWAEPKGPYI

SEQ ID NO: 202934 - protein, 37 aa, Artificial Sequence
  Description of Artificial Sequence: Synthetic polypeptide
CEEEIATTNPVATAQWGCNSSTGEAGINPRDGMEKVN

SEQ ID NO: 202935 - protein, 35 aa, Artificial Sequence
  Description of Artificial Sequence: Synthetic polypeptide
AECENATTNPVAYEEWGVVATGGNTGNAGNDNQNT

SEQ ID NO: 202936 - protein, 38 aa, Artificial Sequence
  Description of Artificial Sequence: Synthetic polypeptide
DEAEIACTNPVATEQYGSCAAATSHGPEAGMPMGETNH

SEQ ID NO: 202937 - protein, 39 aa, Artificial Sequence
  Description of Artificial Sequence: Synthetic polypeptide
DEEEISTTNPVATEQYGQCVCSNWMEDHNAENFISETQA

SEQ ID NO: 202938 - protein, 38 aa, Artificial Sequence
  Description of Artificial Sequence: Synthetic polypeptide
DDEEISTTNPVATEQYGCVCSNWGEDHNAENFISDFQP

SEQ ID NO: 202939 - protein, 38 aa, Artificial Sequence
  Description of Artificial Sequence: Synthetic polypeptide
DEECISTTNPVAYEAYGQCVCSNSGEHNTENFNSDNQA

SEQ ID NO: 202940 - protein, 39 aa, Artificial Sequence
  Description of Artificial Sequence: Synthetic polypeptide
FEEEISTTNPVATEQYGVIIVDNLVDQIMADEEGEGEGT

SEQ ID NO: 202941 - protein, 37 aa, Artificial Sequence
  Description of Artificial Sequence: Synthetic polypeptide
DEMCIATTNPVAYEGYGCVCSTWGEHNAEHFNSETQA

SEQ ID NO: 202942 - protein, 38 aa, Artificial Sequence
  Description of Artificial Sequence: Synthetic polypeptide
DEAEISTTNPVATEQWGCVCSNWGEDHNAENFNSETQS

SEQ ID NO: 202943 - protein, 39 aa, Artificial Sequence
  Description of Artificial Sequence: Synthetic polypeptide
DEAEISTTNPVATEQYGCAVCSNWEEDHNAENFNSDTQA

SEQ ID NO: 202944 - protein, 34 aa, Artificial Sequence
  Description of Artificial Sequence: Synthetic polypeptide
QESEIRSTNPIATEGWGVTTWANSETWAPKGDYI

SEQ ID NO: 202945 - protein, 38 aa, Artificial Sequence
  Description of Artificial Sequence: Synthetic polypeptide
SEEEIRCTNPCATEQYGQCVCSNWGEDDNANFGSDTQS

SEQ ID NO: 202946 - protein, 38 aa, Artificial Sequence
  Description of Artificial Sequence: Synthetic polypeptide
DEMEIATTNPVATEQYGCVCQTWGEDHNAEHFISETQA

SEQ ID NO: 202947 - protein, 37 aa, Artificial Sequence
  Description of Artificial Sequence: Synthetic polypeptide
QEGCIACTNPVATEQYGIISFSAPDTLREPHEGEDTR

SEQ ID NO: 202948 - protein, 35 aa, Artificial Sequence
  Description of Artificial Sequence: Synthetic polypeptide
CEDVIACTNPVATAQWGGCVAIANNLQEAPGGQTH

SEQ ID NO: 202949 - protein, 38 aa, Artificial Sequence
  Description of Artificial Sequence: Synthetic polypeptide
AENEIATTNPVATEGYGQCVCSTWGEDNQEHFISENQA

SEQ ID NO: 202950 - protein, 36 aa, Artificial Sequence
  Description of Artificial Sequence: Synthetic polypeptide
AENEIATTNPVATEGYGQCVCSNWGEHNQHFISEQA

SEQ ID NO: 202951 - protein, 39 aa, Artificial Sequence
  Description of Artificial Sequence: Synthetic polypeptide
FEEEISTTNPVATEGYGVVDVGVGTGNVGQQEGEGEDTE

SEQ ID NO: 202952 - protein, 39 aa, Artificial Sequence
  Description of Artificial Sequence: Synthetic polypeptide
SEEEIRTTNPVAYEQYGQCVCSNWGEDHNQENFNSDTQA

SEQ ID NO: 202953 - protein, 38 aa, Artificial Sequence
  Description of Artificial Sequence: Synthetic polypeptide
SEEEIRTTNPVAYEQYGQCVCGNWGADNQENFISDTQS

SEQ ID NO: 202954 - protein, 38 aa, Artificial Sequence
  Description of Artificial Sequence: Synthetic polypeptide
DEECISTTNPVATEYYGCVCSNWGEDHNQENFNSDTQS

SEQ ID NO: 202955 - protein, 38 aa, Artificial Sequence
  Description of Artificial Sequence: Synthetic polypeptide
DEMCIATTNPVATEQYGQCVCSNWMEHNAEHFNSENQA

SEQ ID NO: 202956 - protein, 36 aa, Artificial Sequence
  Description of Artificial Sequence: Synthetic polypeptide
AENEIATTNPVATEGYGCVCSWGEHNQEHFISDTLA

SEQ ID NO: 202957 - protein, 37 aa, Artificial Sequence
  Description of Artificial Sequence: Synthetic polypeptide
DEACIRTTNPVATEQYGCVCQWGEDPNQEYFISDTQS

SEQ ID NO: 202958 - protein, 37 aa, Artificial Sequence
  Description of Artificial Sequence: Synthetic polypeptide
AENEIATTNPVATEGYGCVCSWGEDPNQEHFISENQA

SEQ ID NO: 202959 - protein, 38 aa, Artificial Sequence
  Description of Artificial Sequence: Synthetic polypeptide
DEAEISTTNPVATEGYGQCVCSVSGEDNAENFISDTQS

SEQ ID NO: 202960 - protein, 39 aa, Artificial Sequence
  Description of Artificial Sequence: Synthetic polypeptide
DEAEISTTNPVATEGYGQCVCSTWGEDHNTENFNSDTQA

SEQ ID NO: 202961 - protein, 38 aa, Artificial Sequence
  Description of Artificial Sequence: Synthetic polypeptide
SEEEISTTNPVATEEYGQCVCSNWGEHNAENFNSDNQA

SEQ ID NO: 202962 - protein, 38 aa, Artificial Sequence
  Description of Artificial Sequence: Synthetic polypeptide
DEAEISTTNPVATEGYGQCVCSNWGEHNAENFNSETQS

SEQ ID NO: 202963 - protein, 38 aa, Artificial Sequence
  Description of Artificial Sequence: Synthetic polypeptide
DEANEIATTNPVAYEQYGSVAIANHAEEATGGGMEMSM

SEQ ID NO: 202964 - protein, 37 aa, Artificial Sequence
  Description of Artificial Sequence: Synthetic polypeptide
CEEEIACTNPVATEQWGCSTGGSGMNPAEASDEMSNW

SEQ ID NO: 202965 - protein, 38 aa, Artificial Sequence
  Description of Artificial Sequence: Synthetic polypeptide
DEAEISTTNPVATEGYGQCVCSNWGEHNAEYFGSDTQS

SEQ ID NO: 202966 - protein, 37 aa, Artificial Sequence
  Description of Artificial Sequence: Synthetic polypeptide
SEEEISCTNPVATEGYGCVCSNWGEHNAEYFNSDTQS

SEQ ID NO: 202967 - protein, 38 aa, Artificial Sequence
  Description of Artificial Sequence: Synthetic polypeptide
DEAEISTTNPVATEGYGQCVCSNWGEHNQENFNSENQF

SEQ ID NO: 202968 - protein, 38 aa, Artificial Sequence
  Description of Artificial Sequence: Synthetic polypeptide
CEEEIACTNPVATEQWGCNVNTPTQDNPIDALDEMENN

SEQ ID NO: 202969 - protein, 38 aa, Artificial Sequence
  Description of Artificial Sequence: Synthetic polypeptide
DENEIRTTNPVSTEPYGCTVISCMEDAISQTQNGGSMH

SEQ ID NO: 202970 - protein, 36 aa, Artificial Sequence
  Description of Artificial Sequence: Synthetic polypeptide
CEEEIACTNPVATEQYGSCAMAGPAEGADSLSGEDA

SEQ ID NO: 202971 - protein, 36 aa, Artificial Sequence
  Description of Artificial Sequence: Synthetic polypeptide
SEEEISCTNPCATEQYGCVCSWGEDNAENFSSDTQS

SEQ ID NO: 202972 - protein, 37 aa, Artificial Sequence
  Description of Artificial Sequence: Synthetic polypeptide
CEEEIACTNPVATEQWGCNVNAMTTLTNPDDGMGDQH

SEQ ID NO: 202973 - protein, 35 aa, Artificial Sequence
  Description of Artificial Sequence: Synthetic polypeptide
DESEIASTNPVGTEGYGATMWANAEDLAEHKGPYI

SEQ ID NO: 202974 - protein, 38 aa, Artificial Sequence
  Description of Artificial Sequence: Synthetic polypeptide
AEEEIRTTNPVAYEGYGQCVCSNWGEHNAENFNSETQS

SEQ ID NO: 202975 - protein, 39 aa, Artificial Sequence
  Description of Artificial Sequence: Synthetic polypeptide
DEESIACTNPVATEQYGSCVAAIGTGDLPATDHGDGEWP

SEQ ID NO: 202976 - protein, 39 aa, Artificial Sequence
  Description of Artificial Sequence: Synthetic polypeptide
DEAEISTTNPVATEGYGQCVCSTWGEDHNAENFNSDTQS

SEQ ID NO: 202977 - protein, 38 aa, Artificial Sequence
  Description of Artificial Sequence: Synthetic polypeptide
DEMCIATTNPVAYEQYGCVCSNWGELHNAEHFGSENQS

SEQ ID NO: 202978 - protein, 38 aa, Artificial Sequence
  Description of Artificial Sequence: Synthetic polypeptide
DEVEIATTNPVATEQWGTNSNAMADTGVNNAHPPGEAP

SEQ ID NO: 202979 - protein, 36 aa, Artificial Sequence
  Description of Artificial Sequence: Synthetic polypeptide
SEEEISCTNPCAYEQYGCVCSWMEDNAENFGSDTQS

SEQ ID NO: 202980 - protein, 38 aa, Artificial Sequence
  Description of Artificial Sequence: Synthetic polypeptide
QEAEIATTNPVATEQWGGCCTAIMNGLEPPDEQAGGKY

SEQ ID NO: 202981 - protein, 38 aa, Artificial Sequence
  Description of Artificial Sequence: Synthetic polypeptide
DEMEIATTNPVATEQYGCVCGNWGEDHNAEHFISENQS

SEQ ID NO: 202982 - protein, 38 aa, Artificial Sequence
  Description of Artificial Sequence: Synthetic polypeptide
DEAEISTTNPVATEQYGCTCSNWGEDDNAENFNSDTQA

SEQ ID NO: 202983 - protein, 33 aa, Artificial Sequence
  Description of Artificial Sequence: Synthetic polypeptide
SDMEIACTNPCSYEQYGCVCSWGEDQSFGSDQS

SEQ ID NO: 202984 - protein, 35 aa, Artificial Sequence
  Description of Artificial Sequence: Synthetic polypeptide
CEDVIACTNPVATAQWGGCVANANGLQEAPGGQHH

SEQ ID NO: 202985 - protein, 38 aa, Artificial Sequence
  Description of Artificial Sequence: Synthetic polypeptide
DEMEIATTNPVATEGYGQCVCSNWGEHNAEHFGSETQG

SEQ ID NO: 202986 - protein, 38 aa, Artificial Sequence
  Description of Artificial Sequence: Synthetic polypeptide
AEMEISTTNPVATEQYGCICSTWGEDTNAENFGSDTQS

SEQ ID NO: 202987 - protein, 40 aa, Artificial Sequence
  Description of Artificial Sequence: Synthetic polypeptide
FEEEIRTTNPVATEQYGVIIVNNLVDQQLEADEEGEGEGT

SEQ ID NO: 202988 - protein, 37 aa, Artificial Sequence
  Description of Artificial Sequence: Synthetic polypeptide
AEMEISTTNPVATEQYGCVCQNWGEDNIENFMSDTQS

SEQ ID NO: 202989 - protein, 33 aa, Artificial Sequence
  Description of Artificial Sequence: Synthetic polypeptide
QESEIRTTNPIATECWGATWAAEDWAEPKGPYI

SEQ ID NO: 202990 - protein, 36 aa, Artificial Sequence
  Description of Artificial Sequence: Synthetic polypeptide
CEEVIACTNPVATEQWGSNVANMNNSNAAGGPGESW

SEQ ID NO: 202991 - protein, 37 aa, Artificial Sequence
  Description of Artificial Sequence: Synthetic polypeptide
CEEEIATTNPVATASWGHSVSAAGAGGTAPQDIADFK

SEQ ID NO: 202992 - protein, 38 aa, Artificial Sequence
  Description of Artificial Sequence: Synthetic polypeptide
AEMEISTTNPVATEQYGCVCSNWEEDHNAENFNSDNQS

SEQ ID NO: 202993 - protein, 37 aa, Artificial Sequence
  Description of Artificial Sequence: Synthetic polypeptide
DENEIRTTNPVSTEGYGCICSWEEDHNAENFISDNQA

SEQ ID NO: 202994 - protein, 38 aa, Artificial Sequence
  Description of Artificial Sequence: Synthetic polypeptide
DEEEIATTNPVATAQWGSICSEANPATPDDSGIGMAEN

SEQ ID NO: 202995 - protein, 37 aa, Artificial Sequence
  Description of Artificial Sequence: Synthetic polypeptide
AEMEISTTNPVATEQYGCVCSNWGEPNAESFISDTQA

SEQ ID NO: 202996 - protein, 34 aa, Artificial Sequence
  Description of Artificial Sequence: Synthetic polypeptide
CETEIACTNPVATAQWGHSASLAGMGLAEDPLEN

SEQ ID NO: 202997 - protein, 37 aa, Artificial Sequence
  Description of Artificial Sequence: Synthetic polypeptide
DENEIRTTNPVSTEGYGCICSNWEEHNAEQFNSDTQG

SEQ ID NO: 202998 - protein, 37 aa, Artificial Sequence
  Description of Artificial Sequence: Synthetic polypeptide
DESEIRTTNPMAYEAWGISVSPVNANSSSDAEGGMVC

SEQ ID NO: 202999 - protein, 36 aa, Artificial Sequence
  Description of Artificial Sequence: Synthetic polypeptide
DESEIRTTNPMAYEAWGISVPVNGNSSSDSEGGMVC

SEQ ID NO: 203000 - protein, 39 aa, Artificial Sequence
  Description of Artificial Sequence: Synthetic polypeptide
DEEEIRTTNPVATEQYGTSWTEHPCSVEEYAEVIMTTEL

SEQ ID NO: 203001 - protein, 38 aa, Artificial Sequence
  Description of Artificial Sequence: Synthetic polypeptide
DEAEIACTNPVATEQYGCNVAAINNGLEADADIDDNQM

SEQ ID NO: 203002 - protein, 36 aa, Artificial Sequence
  Description of Artificial Sequence: Synthetic polypeptide
CEEEIATTNPVATASWGCVSATGAGGTAPQDIADMK

SEQ ID NO: 203003 - protein, 37 aa, Artificial Sequence
  Description of Artificial Sequence: Synthetic polypeptide
DENEIRTTNPVSTEGYGQCICSWEDHNQEYFGSDTQA

SEQ ID NO: 203004 - protein, 38 aa, Artificial Sequence
  Description of Artificial Sequence: Synthetic polypeptide
SEEEIRTTNPVAYEGYGCVTSTWGADHNAENFSSDPQA

SEQ ID NO: 203005 - protein, 37 aa, Artificial Sequence
  Description of Artificial Sequence: Synthetic polypeptide
DEEEIATTNPVATAQWGGCCAAGNFEGLEATANGEFT

SEQ ID NO: 203006 - protein, 36 aa, Artificial Sequence
  Description of Artificial Sequence: Synthetic polypeptide
AENEIATTNPVATEGYGCVCSNWGEDNQEHFISQQA

SEQ ID NO: 203007 - protein, 37 aa, Artificial Sequence
  Description of Artificial Sequence: Synthetic polypeptide
AENEIATTNPVATEGYGCVCSNWGEDHNQHFISENQA

SEQ ID NO: 203008 - protein, 34 aa, Artificial Sequence
  Description of Artificial Sequence: Synthetic polypeptide
QEAEIATTNPVAYAPWGGNTVAGEGHLQNHMNMK

SEQ ID NO: 203009 - protein, 35 aa, Artificial Sequence
  Description of Artificial Sequence: Synthetic polypeptide
AENEIATTNPVATEGYGCVCGWGEPNQEHFISEQA

SEQ ID NO: 203010 - protein, 38 aa, Artificial Sequence
  Description of Artificial Sequence: Synthetic polypeptide
DEMCIATTNPVATEGYGCVCSTWGEDHNEEHFGSETQA

SEQ ID NO: 203011 - protein, 39 aa, Artificial Sequence
  Description of Artificial Sequence: Synthetic polypeptide
DEECISTTNPVATEQYGQCYCSNSGEDHNQENFNSDNQS

SEQ ID NO: 203012 - protein, 37 aa, Artificial Sequence
  Description of Artificial Sequence: Synthetic polypeptide
CEEEIACTNPVATEQYGSVCAAIEHEDAGAPLDEDAE

SEQ ID NO: 203013 - protein, 39 aa, Artificial Sequence
  Description of Artificial Sequence: Synthetic polypeptide
DEMEIATTNPVATEQYGCQVCSNWMEDHNEEHFNSETQA

SEQ ID NO: 203014 - protein, 38 aa, Artificial Sequence
  Description of Artificial Sequence: Synthetic polypeptide
DEECIRTTNPVATEIYGCVCGNWGEDDNAENFNSDTQS

SEQ ID NO: 203015 - protein, 37 aa, Artificial Sequence
  Description of Artificial Sequence: Synthetic polypeptide
DEEEIATTNPVATAQWGGCCAGNFAGLEATANGQEFP

SEQ ID NO: 203016 - protein, 37 aa, Artificial Sequence
  Description of Artificial Sequence: Synthetic polypeptide
DEEEIATTNPVATAQWGGCCAGQGNGLEATANGDEGF

SEQ ID NO: 203017 - protein, 37 aa, Artificial Sequence
  Description of Artificial Sequence: Synthetic polypeptide
DEESIACTNPVATEQYGSACAANPAEGQDHQDDSSAK

SEQ ID NO: 203018 - protein, 38 aa, Artificial Sequence
  Description of Artificial Sequence: Synthetic polypeptide
DEQEIRTTNPVATEQYGSHCIHPWEHDEIPEHVENDQG

SEQ ID NO: 203019 - protein, 37 aa, Artificial Sequence
  Description of Artificial Sequence: Synthetic polypeptide
DEEEIATTNPVATAQWGGCCAGTFNGDEATANGEEFT

SEQ ID NO: 203020 - protein, 39 aa, Artificial Sequence
  Description of Artificial Sequence: Synthetic polypeptide
DEMEIATTNPVATEGYGQCVCSTWGEDHNAEHFNSETQA

SEQ ID NO: 203021 - protein, 37 aa, Artificial Sequence
  Description of Artificial Sequence: Synthetic polypeptide
DEAEIACTNPVATEQYGCNVAAITNGTEAADIDDADM

SEQ ID NO: 203022 - protein, 37 aa, Artificial Sequence
  Description of Artificial Sequence: Synthetic polypeptide
DENEIRTTNPVSTEGYGQCICSWEEDNAEHFNSDTQA

SEQ ID NO: 203023 - protein, 36 aa, Artificial Sequence
  Description of Artificial Sequence: Synthetic polypeptide
AEMEISTTNPVATEGWGCVCSWGEDNAEYFGSDTQS

SEQ ID NO: 203024 - protein, 37 aa, Artificial Sequence
  Description of Artificial Sequence: Synthetic polypeptide
DAEEIATTNPVAYEQWGSVCAMANHADDSKAPGGGHN

SEQ ID NO: 203025 - protein, 38 aa, Artificial Sequence
  Description of Artificial Sequence: Synthetic polypeptide
QEAEIACTNPVATEQYGSVIPPGEMGDPLGADAGNHNN

SEQ ID NO: 203026 - protein, 37 aa, Artificial Sequence
  Description of Artificial Sequence: Synthetic polypeptide
QEAEIACTNPVATEQYGSCAAAPGNHPMAGMEIGNNT

SEQ ID NO: 203027 - protein, 38 aa, Artificial Sequence
  Description of Artificial Sequence: Synthetic polypeptide
CEEEIACTNPVATEQWGCSVIAMSGTGGNTEGVIEQFE

SEQ ID NO: 203028 - protein, 38 aa, Artificial Sequence
  Description of Artificial Sequence: Synthetic polypeptide
AEMEIATTNPVATEQYGQCVCGNWGEHNAEHFGSENQS

SEQ ID NO: 203029 - protein, 39 aa, Artificial Sequence
  Description of Artificial Sequence: Synthetic polypeptide
SEEEITTTNPVATEGYGVVDVGVGTGNVGQQEGEGEDGQ

SEQ ID NO: 203030 - protein, 38 aa, Artificial Sequence
  Description of Artificial Sequence: Synthetic polypeptide
ADEEISTTNPVATEQYGCVCSNSGEDHNAENFNSDTQS

SEQ ID NO: 203031 - protein, 39 aa, Artificial Sequence
  Description of Artificial Sequence: Synthetic polypeptide
SEEEIRATNPVATEGYGMVDNGQGTNDDQEGGGFEQFGD

SEQ ID NO: 203032 - protein, 39 aa, Artificial Sequence
  Description of Artificial Sequence: Synthetic polypeptide
SEEEISTTNPVAYEQYGQCVCSNWGEDHNAENFGSDNQE

SEQ ID NO: 203033 - protein, 38 aa, Artificial Sequence
  Description of Artificial Sequence: Synthetic polypeptide
SEEEISTTNPVAYEQYGQCVCSMWGEHNAENFNSDNQG

SEQ ID NO: 203034 - protein, 38 aa, Artificial Sequence
  Description of Artificial Sequence: Synthetic polypeptide
SEEEISTTNPVAYEQYGCVCSNWGEDHNAENFNSDTQS

SEQ ID NO: 203035 - protein, 38 aa, Artificial Sequence
  Description of Artificial Sequence: Synthetic polypeptide
ADEEISTTNPVATEQYGCVCSNWGEDHNAEYFNSETQA

SEQ ID NO: 203036 - protein, 36 aa, Artificial Sequence
  Description of Artificial Sequence: Synthetic polypeptide
DETVIATTNPVAYEQWGCVACCTVPPPSDRPPGQEP

SEQ ID NO: 203037 - protein, 36 aa, Artificial Sequence
  Description of Artificial Sequence: Synthetic polypeptide
DEAEISTTNPVAYEGWGCVCSWGEENAEYFGSDTQA

SEQ ID NO: 203038 - protein, 38 aa, Artificial Sequence
  Description of Artificial Sequence: Synthetic polypeptide
DEQEIATTNPVAYEQWGSPIAITPHQDENTGGGMENDD

SEQ ID NO: 203039 - protein, 37 aa, Artificial Sequence
  Description of Artificial Sequence: Synthetic polypeptide
DEESIACTNPVAYEQYGSCAAAGGNHGNAEGNDGNNH

SEQ ID NO: 203040 - protein, 37 aa, Artificial Sequence
  Description of Artificial Sequence: Synthetic polypeptide
CEEEIACTNPVATEQYGSACAAANPAEGQDHQDDSAK

SEQ ID NO: 203041 - protein, 36 aa, Artificial Sequence
  Description of Artificial Sequence: Synthetic polypeptide
DEESIACTNPVAYEQYGSCAAAGGNHGNAEGEGMDN

SEQ ID NO: 203042 - protein, 38 aa, Artificial Sequence
  Description of Artificial Sequence: Synthetic polypeptide
AEACIRTTNPVATEQYGQCVCSNWGEDNAEFFNSDNQS

SEQ ID NO: 203043 - protein, 35 aa, Artificial Sequence
  Description of Artificial Sequence: Synthetic polypeptide
DENEIRTTNPIATECWGATTWANAEDWAEPKGPYI

SEQ ID NO: 203044 - protein, 37 aa, Artificial Sequence
  Description of Artificial Sequence: Synthetic polypeptide
AEACIRTTNPVATEQYGCVCENWGEPNAEYFNSDNQA

SEQ ID NO: 203045 - protein, 38 aa, Artificial Sequence
  Description of Artificial Sequence: Synthetic polypeptide
AEACIRTTNPVATEQYGCVCENWGEDPNQEYFNSDTQS

SEQ ID NO: 203046 - protein, 37 aa, Artificial Sequence
  Description of Artificial Sequence: Synthetic polypeptide
AEMEIRTTNPVATEGWGCVCSWGEDHNQEYFGSDTQA

SEQ ID NO: 203047 - protein, 36 aa, Artificial Sequence
  Description of Artificial Sequence: Synthetic polypeptide
DETVIATTNPVAYEQWGCVAACTVPPSDRMPGQEPD

SEQ ID NO: 203048 - protein, 35 aa, Artificial Sequence
  Description of Artificial Sequence: Synthetic polypeptide
DETVIATTNPVAYENWGCVAACTVPPSDRPPGKEP

SEQ ID NO: 203049 - protein, 37 aa, Artificial Sequence
  Description of Artificial Sequence: Synthetic polypeptide
DEMCIGTTNPVATEQWGCVCSWGEDHNAEYFGSQTQS

SEQ ID NO: 203050 - protein, 37 aa, Artificial Sequence
  Description of Artificial Sequence: Synthetic polypeptide
DAEEIATTNPVAYEQWGGCVCASGDDGVNHQDEADHQ

SEQ ID NO: 203051 - protein, 38 aa, Artificial Sequence
  Description of Artificial Sequence: Synthetic polypeptide
DDEEISTTNPVATEQYGCVCSNWGEDHNEENFMSDTQS

SEQ ID NO: 203052 - protein, 38 aa, Artificial Sequence
  Description of Artificial Sequence: Synthetic polypeptide
SEEEVRTTNPVATEGYGQCVCSNWGEHNAEYINSDTQS

SEQ ID NO: 203053 - protein, 37 aa, Artificial Sequence
  Description of Artificial Sequence: Synthetic polypeptide
AEMEIATTNPVATEGYGCVCSWGELHNQEHFISETQA

SEQ ID NO: 203054 - protein, 37 aa, Artificial Sequence
  Description of Artificial Sequence: Synthetic polypeptide
DETSEIATTNPVAYERWGSAYITDNMNGGQDEHGDEN

SEQ ID NO: 203055 - protein, 38 aa, Artificial Sequence
  Description of Artificial Sequence: Synthetic polypeptide
CEDEIRTTNPVATEGYGSVINNDEFDNEEDEDGGGQGN

SEQ ID NO: 203056 - protein, 37 aa, Artificial Sequence
  Description of Artificial Sequence: Synthetic polypeptide
DEGEIACTNPVATAQWGHSPSATWPAGTNQGAGMEPV

SEQ ID NO: 203057 - protein, 35 aa, Artificial Sequence
  Description of Artificial Sequence: Synthetic polypeptide
DETSIASTNPVATEQWGTNCSAAAHGMNRDSGDSW

SEQ ID NO: 203058 - protein, 37 aa, Artificial Sequence
  Description of Artificial Sequence: Synthetic polypeptide
DEGEIACTNPVATAQWGHSASAVGDLEADTPHGEDNH

SEQ ID NO: 203059 - protein, 38 aa, Artificial Sequence
  Description of Artificial Sequence: Synthetic polypeptide
CEEEIACTNPVAYEPYGSTVAAITNNEEAPGNQMEANP

SEQ ID NO: 203060 - protein, 38 aa, Artificial Sequence
  Description of Artificial Sequence: Synthetic polypeptide
CEEEIACTNPVATESYGVSACSAANPAEADAEIGENTA

SEQ ID NO: 203061 - protein, 38 aa, Artificial Sequence
  Description of Artificial Sequence: Synthetic polypeptide
SEEELRTTNPVATEQYGCVCSNWGEDHDAEYINSDTQS

SEQ ID NO: 203062 - protein, 40 aa, Artificial Sequence
  Description of Artificial Sequence: Synthetic polypeptide
DEDEIRTTNPVATEQWGVVVVVVVVVVVTVTQAGNTEEGD

SEQ ID NO: 203063 - protein, 38 aa, Artificial Sequence
  Description of Artificial Sequence: Synthetic polypeptide
DEDEIRTTNPVATEQYGMMGYDGLGNMNDIMDNGGTGT

SEQ ID NO: 203064 - protein, 37 aa, Artificial Sequence
  Description of Artificial Sequence: Synthetic polypeptide
CEEEIACTNPVATESYGVCTACAANNESETEHGNDTQ

SEQ ID NO: 203065 - protein, 37 aa, Artificial Sequence
  Description of Artificial Sequence: Synthetic polypeptide
DEGEIACTNPVATAQWGCSNATTGNHLPAPMEENHNN

SEQ ID NO: 203066 - protein, 36 aa, Artificial Sequence
  Description of Artificial Sequence: Synthetic polypeptide
DEGEIACTNPVATAQWGCSNATTGGHLPAPMENHNM

SEQ ID NO: 203067 - protein, 38 aa, Artificial Sequence
  Description of Artificial Sequence: Synthetic polypeptide
AEMEIATTNPVATEQYGICSCPNSGEDNAEHFNSENQS

SEQ ID NO: 203068 - protein, 38 aa, Artificial Sequence
  Description of Artificial Sequence: Synthetic polypeptide
AEMEIATTNPVATEQYGQCSCGNWGEDNQEHFISENQA

SEQ ID NO: 203069 - protein, 37 aa, Artificial Sequence
  Description of Artificial Sequence: Synthetic polypeptide
SEEEIRCTNPCATEAYGQCVCSWGEDNAENFGSDTQS

SEQ ID NO: 203070 - protein, 39 aa, Artificial Sequence
  Description of Artificial Sequence: Synthetic polypeptide
AEEEIRTTNPVAYEQYGQCVCSNWGEDHNAENFNSDTQA

SEQ ID NO: 203071 - protein, 37 aa, Artificial Sequence
  Description of Artificial Sequence: Synthetic polypeptide
SEEEIRCTNPCATEEYGCVCSNWGEPNAEHFGSDTQA

SEQ ID NO: 203072 - protein, 39 aa, Artificial Sequence
  Description of Artificial Sequence: Synthetic polypeptide
DEAEIRTTNPVATEQWGQCVCSNWGEDHNQENFNSDNQS

SEQ ID NO: 203073 - protein, 38 aa, Artificial Sequence
  Description of Artificial Sequence: Synthetic polypeptide
QESEICTTNPVATEQYGDVVIMTQGGPEGMLINDNNIE

SEQ ID NO: 203074 - protein, 37 aa, Artificial Sequence
  Description of Artificial Sequence: Synthetic polypeptide
DDACISTTNPVATEQYGCVCSNWGEHNQEYFNSDTQS

SEQ ID NO: 203075 - protein, 38 aa, Artificial Sequence
  Description of Artificial Sequence: Synthetic polypeptide
SEEEIRCTNPCATEQYGCVCSNWMEDHNAENFNSDTQS

SEQ ID NO: 203076 - protein, 35 aa, Artificial Sequence
  Description of Artificial Sequence: Synthetic polypeptide
DECEIATTNPIATECWGATYYAMENDQHEKTGKTM

SEQ ID NO: 203077 - protein, 38 aa, Artificial Sequence
  Description of Artificial Sequence: Synthetic polypeptide
DEAEISTTNPVATEGYGQCVCSNWGEHNAENFNSDTQN

SEQ ID NO: 203078 - protein, 35 aa, Artificial Sequence
  Description of Artificial Sequence: Synthetic polypeptide
DENEIRTTNPIATECWGATTWSNAEDWAEPKGPYI

SEQ ID NO: 203079 - protein, 37 aa, Artificial Sequence
  Description of Artificial Sequence: Synthetic polypeptide
QESEIRATNPAATDAYGSVVVVSTGTNAGMEGEDGQG

SEQ ID NO: 203080 - protein, 38 aa, Artificial Sequence
  Description of Artificial Sequence: Synthetic polypeptide
DEAEISTTNPVATEGYGQCVCSNWGEHNAENFNSDTQS

SEQ ID NO: 203081 - protein, 35 aa, Artificial Sequence
  Description of Artificial Sequence: Synthetic polypeptide
DEVEIATTNPVATAQWGTNCAATDGHPVEFEINDD

SEQ ID NO: 203082 - protein, 38 aa, Artificial Sequence
  Description of Artificial Sequence: Synthetic polypeptide
DEAEISTTNPVATEGYGQCVCSNWGEHNAENFNSENQS

SEQ ID NO: 203083 - protein, 39 aa, Artificial Sequence
  Description of Artificial Sequence: Synthetic polypeptide
SEEEISTTNPVATEGYGVVDVGVGTGNDGQQEGEGEDTN

SEQ ID NO: 203084 - protein, 38 aa, Artificial Sequence
  Description of Artificial Sequence: Synthetic polypeptide
SEEEISTTNPVATEGYGQCVCSNWGEHNAENFNSDNQA

SEQ ID NO: 203085 - protein, 38 aa, Artificial Sequence
  Description of Artificial Sequence: Synthetic polypeptide
SEEEISTTNPVATEGYGQCVCSNSEEHNAENFNSENQA

SEQ ID NO: 203086 - protein, 38 aa, Artificial Sequence
  Description of Artificial Sequence: Synthetic polypeptide
DEECIRTTNPVATEQFGQCVCSNWMYHNAENFISETQS

SEQ ID NO: 203087 - protein, 39 aa, Artificial Sequence
  Description of Artificial Sequence: Synthetic polypeptide
AEEEISTTNPVATEQYGQCVCSNWMEDHNAENFNSENQN

SEQ ID NO: 203088 - protein, 37 aa, Artificial Sequence
  Description of Artificial Sequence: Synthetic polypeptide
SEEEISTTNPVATEGYGCVCSNWGEHNAENFMSDTQS

SEQ ID NO: 203089 - protein, 38 aa, Artificial Sequence
  Description of Artificial Sequence: Synthetic polypeptide
SEEEISTTNPVATEGYGCVCSNWGEDHNAENFNSDNQA

SEQ ID NO: 203090 - protein, 38 aa, Artificial Sequence
  Description of Artificial Sequence: Synthetic polypeptide
SEEEISTTNPVATEGYGCVCSNWGEDHNAENFNSDFQA

SEQ ID NO: 203091 - protein, 39 aa, Artificial Sequence
  Description of Artificial Sequence: Synthetic polypeptide
SEEEISTTNPVATEGYGVVDVGVGTGNVGQEEGEGEDTQ

SEQ ID NO: 203092 - protein, 37 aa, Artificial Sequence
  Description of Artificial Sequence: Synthetic polypeptide
DEVEIATTNPVATAQWGANTTTSAMNHLAGMPGGSHK

SEQ ID NO: 203093 - protein, 35 aa, Artificial Sequence
  Description of Artificial Sequence: Synthetic polypeptide
DENEIRTTNPIATECWGATTWANAETWAEPKGPYI

SEQ ID NO: 203094 - protein, 38 aa, Artificial Sequence
  Description of Artificial Sequence: Synthetic polypeptide
SEEEIRCTNPCATEQYGCVCSNWGEDDNAENFISDNQS

SEQ ID NO: 203095 - protein, 39 aa, Artificial Sequence
  Description of Artificial Sequence: Synthetic polypeptide
FEKEEIFRATVCIDVAADEGQYGAVDITMNHLQQRWMRR

SEQ ID NO: 203096 - protein, 36 aa, Artificial Sequence
  Description of Artificial Sequence: Synthetic polypeptide
SEEEIRCTNPCATEGYGCVCSWGEHNAENFMSDTQS

SEQ ID NO: 203097 - protein, 39 aa, Artificial Sequence
  Description of Artificial Sequence: Synthetic polypeptide
SEEEISTTNPVATEQYGQCVCSNWGEDHNQEHFNSENQA

SEQ ID NO: 203098 - protein, 39 aa, Artificial Sequence
  Description of Artificial Sequence: Synthetic polypeptide
SEEEISTTNPVATEQYGQCVCSNWGEDHNAENFNSETQS

SEQ ID NO: 203099 - protein, 39 aa, Artificial Sequence
  Description of Artificial Sequence: Synthetic polypeptide
SEEEISTTNPVATEQYGQCVCSNWGEDHNAENFNSDTQP

SEQ ID NO: 203100 - protein, 39 aa, Artificial Sequence
  Description of Artificial Sequence: Synthetic polypeptide
SEEEISTTNPVATEQYGQCVCSNWGEDHNAENFNSDTQA

SEQ ID NO: 203101 - protein, 39 aa, Artificial Sequence
  Description of Artificial Sequence: Synthetic polypeptide
SEEEISTTNPVATEQYGQCVCSNWGEDHNAENFISDNQS

SEQ ID NO: 203102 - protein, 39 aa, Artificial Sequence
  Description of Artificial Sequence: Synthetic polypeptide
SEEEISTTNPVATEQYGQCVCSNWGEDHNAEHFNSDTQA

SEQ ID NO: 203103 - protein, 39 aa, Artificial Sequence
  Description of Artificial Sequence: Synthetic polypeptide
SEEEISTTNPVATEQYGQCVCSNWGEDHNAEGFNSDTQS

SEQ ID NO: 203104 - protein, 39 aa, Artificial Sequence
  Description of Artificial Sequence: Synthetic polypeptide
SEEEISTTNPVATEQYGQCVCSNWGEDDNAENFNSETQA

SEQ ID NO: 203105 - protein, 37 aa, Artificial Sequence
  Description of Artificial Sequence: Synthetic polypeptide
SEEEISTTNPVATEQYGQCVCGWGADNAENFISDTQS

SEQ ID NO: 203106 - protein, 38 aa, Artificial Sequence
  Description of Artificial Sequence: Synthetic polypeptide
SEEEISTTNPVATEQYGQCVCGNWGEHNAEFFNSENQA

SEQ ID NO: 203107 - protein, 36 aa, Artificial Sequence
  Description of Artificial Sequence: Synthetic polypeptide
AEACIATTNPVATEGYGCVCSWGEDNQEHFISENQA

SEQ ID NO: 203108 - protein, 36 aa, Artificial Sequence
  Description of Artificial Sequence: Synthetic polypeptide
DEMCIGTTNPVATEGWGCVCSWGEDHNQEYFGSDQA

SEQ ID NO: 203109 - protein, 37 aa, Artificial Sequence
  Description of Artificial Sequence: Synthetic polypeptide
SEEEIRCTNPCATEQYGCVCQNWMEHNAENFGSDTQS

SEQ ID NO: 203110 - protein, 36 aa, Artificial Sequence
  Description of Artificial Sequence: Synthetic polypeptide
SEAAISTTNPVATEQYGCFCSWGEHNIENFNSDTQS

SEQ ID NO: 203111 - protein, 36 aa, Artificial Sequence
  Description of Artificial Sequence: Synthetic polypeptide
DEVAEIATTNPVAYEAWGVVWPGPNNENDEGQNGSE

SEQ ID NO: 203112 - protein, 36 aa, Artificial Sequence
  Description of Artificial Sequence: Synthetic polypeptide
DEVAIGTTNPVATEQYGCLCTAQDGSPVEFETSDKQ

SEQ ID NO: 203113 - protein, 38 aa, Artificial Sequence
  Description of Artificial Sequence: Synthetic polypeptide
SEEEIRCTNPCATEQYGCVCSNWGEDDNAEHFNSDTQS

SEQ ID NO: 203114 - protein, 37 aa, Artificial Sequence
  Description of Artificial Sequence: Synthetic polypeptide
SEEEIRCTNPCATEGYGCVCSNWGEDNAEHFNSDNQS

SEQ ID NO: 203115 - protein, 39 aa, Artificial Sequence
  Description of Artificial Sequence: Synthetic polypeptide
DEECISTTNPVATEQYGQCVCSNWGEDHNAEYFNSDTQS

SEQ ID NO: 203116 - protein, 39 aa, Artificial Sequence
  Description of Artificial Sequence: Synthetic polypeptide
DEECISTTNPVATEQYGQCVCSNWGEDHNAESFISENQP

SEQ ID NO: 203117 - protein, 39 aa, Artificial Sequence
  Description of Artificial Sequence: Synthetic polypeptide
DEECISTTNPVATEQYGQCVCSNWGEDHNAENSNSDTQA

SEQ ID NO: 203118 - protein, 38 aa, Artificial Sequence
  Description of Artificial Sequence: Synthetic polypeptide
AEEEISTTNPVATEQYGQCVCGNWGEHNQENFISDTQA

SEQ ID NO: 203119 - protein, 38 aa, Artificial Sequence
  Description of Artificial Sequence: Synthetic polypeptide
DSAEIRTTNPVATEQYGVCIGCPLPNEEQYEYGEEDHC

SEQ ID NO: 203120 - protein, 37 aa, Artificial Sequence
  Description of Artificial Sequence: Synthetic polypeptide
CEEEISTTNPVATEQYGCVCSNSGEHDIEHFISDTQA

SEQ ID NO: 203121 - protein, 35 aa, Artificial Sequence
  Description of Artificial Sequence: Synthetic polypeptide
DESEIRSTNPVSTECWGCIAPEDDQQQQQQKGTNS

SEQ ID NO: 203122 - protein, 35 aa, Artificial Sequence
  Description of Artificial Sequence: Synthetic polypeptide
DEMEIACTNPVATEQWGTNCAATDGHPVENFEIND

SEQ ID NO: 203123 - protein, 39 aa, Artificial Sequence
  Description of Artificial Sequence: Synthetic polypeptide
AEEEISTTNPVATEQYGQCVCQNWGEDHNAEGFNSDNQS

SEQ ID NO: 203124 - protein, 39 aa, Artificial Sequence
  Description of Artificial Sequence: Synthetic polypeptide
AEEEISTTNPVATEQYGQCVCQNWGEDHNAENFGSDNQS

SEQ ID NO: 203125 - protein, 38 aa, Artificial Sequence
  Description of Artificial Sequence: Synthetic polypeptide
DEEAISTTNPVAYEQYGQCVCSWGEDHNQEYFGSETQS

SEQ ID NO: 203126 - protein, 38 aa, Artificial Sequence
  Description of Artificial Sequence: Synthetic polypeptide
SAEEIATTNPVATEQYGSTVCAGNGVGDEATAGEGTED

SEQ ID NO: 203127 - protein, 38 aa, Artificial Sequence
  Description of Artificial Sequence: Synthetic polypeptide
DEEAISTTNPVAYEQYGQCVCSNWMEDHNAEYFGSQQA

SEQ ID NO: 203128 - protein, 39 aa, Artificial Sequence
  Description of Artificial Sequence: Synthetic polypeptide
DEAEISTTNPVATEQYGQCVCSNWGEDHNAENFGSDTQA

SEQ ID NO: 203129 - protein, 38 aa, Artificial Sequence
  Description of Artificial Sequence: Synthetic polypeptide
DEHNEIATTNPCAYEQWGEVCSTPNQGNHGEAGGDGNN

SEQ ID NO: 203130 - protein, 37 aa, Artificial Sequence
  Description of Artificial Sequence: Synthetic polypeptide
CEECISTTNPVATEQYGCVCSWGEDHDIEHFNSDTQS

SEQ ID NO: 203131 - protein, 37 aa, Artificial Sequence
  Description of Artificial Sequence: Synthetic polypeptide
SAEEIATTNPVATEQYGSACAANNGPEADMPGGEMTP

SEQ ID NO: 203132 - protein, 39 aa, Artificial Sequence
  Description of Artificial Sequence: Synthetic polypeptide
DEEEIRTTNPCATEGYGQCCCSTWGEDHNAENFNSDTQA

SEQ ID NO: 203133 - protein, 38 aa, Artificial Sequence
  Description of Artificial Sequence: Synthetic polypeptide
AEEEISTTNPVATEQYGQCVCQNWGEHNAENFNSDTQA

SEQ ID NO: 203134 - protein, 38 aa, Artificial Sequence
  Description of Artificial Sequence: Synthetic polypeptide
AEEEISTTNPVATEQYGQCVCSNWGEDNQENFISEFQG

SEQ ID NO: 203135 - protein, 39 aa, Artificial Sequence
  Description of Artificial Sequence: Synthetic polypeptide
AEEEISTTNPVATEQYGQCVCSMWGEDHNAEYFNSDTQS

SEQ ID NO: 203136 - protein, 38 aa, Artificial Sequence
  Description of Artificial Sequence: Synthetic polypeptide
DEEAISTTNPVAYEQYGQCVCSNWGEHNAENFNSDTQS

SEQ ID NO: 203137 - protein, 37 aa, Artificial Sequence
  Description of Artificial Sequence: Synthetic polypeptide
SAEEIATTNPVATEQYGCVAPGEGGHGQHSGEEEGML

SEQ ID NO: 203138 - protein, 39 aa, Artificial Sequence
  Description of Artificial Sequence: Synthetic polypeptide
DEAEISTTNPVATEQYGQCVCSNWGEDHNAENFGSDTQS

SEQ ID NO: 203139 - protein, 38 aa, Artificial Sequence
  Description of Artificial Sequence: Synthetic polypeptide
CEEEISTTNPVATEQYGCVCPNWGEDDNAENFNSDNQA

SEQ ID NO: 203140 - protein, 37 aa, Artificial Sequence
  Description of Artificial Sequence: Synthetic polypeptide
QEDEIATTNPVATEQWGGCNVAGTGQLDNIMGEGALH

SEQ ID NO: 203141 - protein, 39 aa, Artificial Sequence
  Description of Artificial Sequence: Synthetic polypeptide
DENEIRTTNPVATEQWGSVDVANGEEGEEMGAGEGDGQN

SEQ ID NO: 203142 - protein, 38 aa, Artificial Sequence
  Description of Artificial Sequence: Synthetic polypeptide
DEACISTTNPVATEGYGCVTSTWGADHNAENFQSDPQA

SEQ ID NO: 203143 - protein, 38 aa, Artificial Sequence
  Description of Artificial Sequence: Synthetic polypeptide
CEEEISTTNPVATEQYGCAVCSNWEEHNAENFISDTQS

SEQ ID NO: 203144 - protein, 38 aa, Artificial Sequence
  Description of Artificial Sequence: Synthetic polypeptide
DEEEIRTTNPCATEGYGQCYCSNWGEDNAENFGSDTQA

SEQ ID NO: 203145 - protein, 38 aa, Artificial Sequence
  Description of Artificial Sequence: Synthetic polypeptide
DEECISTTNPVATEGYGCVCSNWGEDHNIENFNSEFQG

SEQ ID NO: 203146 - protein, 39 aa, Artificial Sequence
  Description of Artificial Sequence: Synthetic polypeptide
AEEEISTTNPVATEQYGQCVCSNWGEEHNAENFNSDTQS

SEQ ID NO: 203147 - protein, 38 aa, Artificial Sequence
  Description of Artificial Sequence: Synthetic polypeptide
DEEEIRTTNPCATEGYGQCFCSNWGEHNAEYFGSDTQS

SEQ ID NO: 203148 - protein, 38 aa, Artificial Sequence
  Description of Artificial Sequence: Synthetic polypeptide
AEEEISTTNPVATEQYGQCVCGNWGEHNAENFNSDNQM

SEQ ID NO: 203149 - protein, 37 aa, Artificial Sequence
  Description of Artificial Sequence: Synthetic polypeptide
DEECIATTNPVATEGYGQCVCNWEDHNQEYFNSDTQS

SEQ ID NO: 203150 - protein, 36 aa, Artificial Sequence
  Description of Artificial Sequence: Synthetic polypeptide
DSAEIATTNPVAYEEWGSVALQQNMHDMNASGNEYK

SEQ ID NO: 203151 - protein, 36 aa, Artificial Sequence
  Description of Artificial Sequence: Synthetic polypeptide
DSAEIATTNPVAYEEWGSVNQQQNMHSMGASGNEYK

SEQ ID NO: 203152 - protein, 36 aa, Artificial Sequence
  Description of Artificial Sequence: Synthetic polypeptide
DSAEIATTNPVAYEEWGSVRLQQNMHSHNASGNEYW

SEQ ID NO: 203153 - protein, 36 aa, Artificial Sequence
  Description of Artificial Sequence: Synthetic polypeptide
DSAEIATTNPVAYEEWGSVRLQQNMHSMTASGNYYK

SEQ ID NO: 203154 - protein, 37 aa, Artificial Sequence
  Description of Artificial Sequence: Synthetic polypeptide
DEECIATTNPVATEGYGCVCNMWGEDHNQEYFNSDQS

SEQ ID NO: 203155 - protein, 36 aa, Artificial Sequence
  Description of Artificial Sequence: Synthetic polypeptide
DSAEIATTNPVAYEEWGSVRQQQNNHSMNAVGNEYK

SEQ ID NO: 203156 - protein, 36 aa, Artificial Sequence
  Description of Artificial Sequence: Synthetic polypeptide
DSAEIATTNPVAYEEWGSVTCQQNMHSMVASGNEYK

SEQ ID NO: 203157 - protein, 36 aa, Artificial Sequence
  Description of Artificial Sequence: Synthetic polypeptide
DSAEIKTTNPVAYEEWGSVRQQQNMHSMNASGNELK

SEQ ID NO: 203158 - protein, 38 aa, Artificial Sequence
  Description of Artificial Sequence: Synthetic polypeptide
DEECIATTNPVATEGYGCVCNNWGEDDNQEYFGSETQS

SEQ ID NO: 203159 - protein, 39 aa, Artificial Sequence
  Description of Artificial Sequence: Synthetic polypeptide
AEEEISTTNPVATEQYGQCVCSMWGEDHNAEYFNSETQS

SEQ ID NO: 203160 - protein, 38 aa, Artificial Sequence
  Description of Artificial Sequence: Synthetic polypeptide
DEEAISTTNPVAYEQYGCVCSNWGEDHNAESFNSDTQA

SEQ ID NO: 203161 - protein, 39 aa, Artificial Sequence
  Description of Artificial Sequence: Synthetic polypeptide
AEEEISTTNPVATEQYGQCVCSMWGEEHNAENFNSDTQA

SEQ ID NO: 203162 - protein, 39 aa, Artificial Sequence
  Description of Artificial Sequence: Synthetic polypeptide
DEEEIRTTNPVAYEGYGQCVCFNWGEDHNTENFNSDNQS

SEQ ID NO: 203163 - protein, 37 aa, Artificial Sequence
  Description of Artificial Sequence: Synthetic polypeptide
CEECISTTNPVATEQYGCVCGNWGEHNAENFNSETQS

SEQ ID NO: 203164 - protein, 37 aa, Artificial Sequence
  Description of Artificial Sequence: Synthetic polypeptide
SAEEIATTNPVATEQYGCVAPGEGGHGNESAEEAKKD

SEQ ID NO: 203165 - protein, 38 aa, Artificial Sequence
  Description of Artificial Sequence: Synthetic polypeptide
DEEEIRTTNPVAYEGYGICVCSWGEDDNAENFISDTQS

SEQ ID NO: 203166 - protein, 38 aa, Artificial Sequence
  Description of Artificial Sequence: Synthetic polypeptide
DEEEIRTTNPVAYEGYGICVCSNWVEHNQENFISQTQA

SEQ ID NO: 203167 - protein, 39 aa, Artificial Sequence
  Description of Artificial Sequence: Synthetic polypeptide
DEEEIRTTNPVATEQWGAFDNYVPNGPMNIEMVQGDITD

SEQ ID NO: 203168 - protein, 35 aa, Artificial Sequence
  Description of Artificial Sequence: Synthetic polypeptide
QENEIATTNPVATASWGCVAGEGEEMNAALFDNND

SEQ ID NO: 203169 - protein, 39 aa, Artificial Sequence
  Description of Artificial Sequence: Synthetic polypeptide
AEEEISTTNPVATEQYGQCVCSNSMEDDNEEFFNSDTQS

SEQ ID NO: 203170 - protein, 39 aa, Artificial Sequence
  Description of Artificial Sequence: Synthetic polypeptide
DEEEIRTTNPVAYEGYGQCVCSMWEEDHNAENFNSDTQS

SEQ ID NO: 203171 - protein, 38 aa, Artificial Sequence
  Description of Artificial Sequence: Synthetic polypeptide
DEEEIRTTNPVAYEGYGCVTGTWGADHNAENFISDPQA

SEQ ID NO: 203172 - protein, 38 aa, Artificial Sequence
  Description of Artificial Sequence: Synthetic polypeptide
DEEAISTTNPVATEQYGQCVCSWGEDHNQENFFSDTQA

SEQ ID NO: 203173 - protein, 38 aa, Artificial Sequence
  Description of Artificial Sequence: Synthetic polypeptide
DEEAISTTNPVATEQYGQCVCSWGEDHNAENFISETQA

SEQ ID NO: 203174 - protein, 35 aa, Artificial Sequence
  Description of Artificial Sequence: Synthetic polypeptide
QENEIATTNPVATASWGCVAGEGEEMNAALQDNHT

SEQ ID NO: 203175 - protein, 35 aa, Artificial Sequence
  Description of Artificial Sequence: Synthetic polypeptide
DEHTIATTNPVAYECWGTVYRINENQDRQMIHVGS

SEQ ID NO: 203176 - protein, 37 aa, Artificial Sequence
  Description of Artificial Sequence: Synthetic polypeptide
DEHVAEIATTNPVAYERWGSTYSGPNGEGPTRDDQER

SEQ ID NO: 203177 - protein, 39 aa, Artificial Sequence
  Description of Artificial Sequence: Synthetic polypeptide
DEEAISTTNPVATEQYGQCVCSNWGYDHNAEFFNSDTQS

SEQ ID NO: 203178 - protein, 38 aa, Artificial Sequence
  Description of Artificial Sequence: Synthetic polypeptide
DEEEIRTTNPCATEEYGQCVCQNWEEHNAENFISDTAA

SEQ ID NO: 203179 - protein, 38 aa, Artificial Sequence
  Description of Artificial Sequence: Synthetic polypeptide
DEEEIRTTNPCATEEYGQCVCGWGEAHNAENFNSDTAA

SEQ ID NO: 203180 - protein, 38 aa, Artificial Sequence
  Description of Artificial Sequence: Synthetic polypeptide
DEEEIRTTNPVAYEGYGCVCGNWGEDHNTEYFGSDTQA

SEQ ID NO: 203181 - protein, 35 aa, Artificial Sequence
  Description of Artificial Sequence: Synthetic polypeptide
QENEIATTNPVATAQWGCVAGEGPEEMNAALDNHP

SEQ ID NO: 203182 - protein, 36 aa, Artificial Sequence
  Description of Artificial Sequence: Synthetic polypeptide
QENEIATTNPVATAQWGCVAGEGGEEMNASLGDNHD

SEQ ID NO: 203183 - protein, 34 aa, Artificial Sequence
  Description of Artificial Sequence: Synthetic polypeptide
DSEDIATTNPVATAQWGGCCAPADSHGRDSMNGN

SEQ ID NO: 203184 - protein, 39 aa, Artificial Sequence
  Description of Artificial Sequence: Synthetic polypeptide
AEEEISTTNPVATEQYGQCVCSNSGEDHNAEYFNSDTQS

SEQ ID NO: 203185 - protein, 38 aa, Artificial Sequence
  Description of Artificial Sequence: Synthetic polypeptide
DEEAISTTNPVAYEQYGCVCSNWGEDHNAENFNSDTQS

SEQ ID NO: 203186 - protein, 35 aa, Artificial Sequence
  Description of Artificial Sequence: Synthetic polypeptide
DEMEIACTNPVATEQWGTNCAATDGGVETPEINND

SEQ ID NO: 203187 - protein, 35 aa, Artificial Sequence
  Description of Artificial Sequence: Synthetic polypeptide
CETEIACTNPVATEQWGCVAGTEGGEAGPGEEDAM

SEQ ID NO: 203188 - protein, 38 aa, Artificial Sequence
  Description of Artificial Sequence: Synthetic polypeptide
DEEAISTTNPVAYEQYGCVCSNWGEDHNAENFNSDTQQ

SEQ ID NO: 203189 - protein, 37 aa, Artificial Sequence
  Description of Artificial Sequence: Synthetic polypeptide
SAEEIATTNPVATEQYGCVAPGEGGHGNESGEEDNMD

SEQ ID NO: 203190 - protein, 37 aa, Artificial Sequence
  Description of Artificial Sequence: Synthetic polypeptide
SAEEIATTNPVATEQYGCVAPGEGGHGNESGEEDGSL

SEQ ID NO: 203191 - protein, 38 aa, Artificial Sequence
  Description of Artificial Sequence: Synthetic polypeptide
DEEAISTTNPVAYEQYGCVCSNWGEDHNAENFNSDTQA

SEQ ID NO: 203192 - protein, 38 aa, Artificial Sequence
  Description of Artificial Sequence: Synthetic polypeptide
DEEAISTTNPVAYEQYGCVCSMWGEDHNAENFNSDFQI

SEQ ID NO: 203193 - protein, 38 aa, Artificial Sequence
  Description of Artificial Sequence: Synthetic polypeptide
CEECISTTNPVATEQYGCVCSNWGEDHNAENFGSDTQS

SEQ ID NO: 203194 - protein, 37 aa, Artificial Sequence
  Description of Artificial Sequence: Synthetic polypeptide
SAEEIATTNPVATEQYGCVAPGEGGHGNESAEEDGMV

SEQ ID NO: 203195 - protein, 35 aa, Artificial Sequence
  Description of Artificial Sequence: Synthetic polypeptide
QENEIATTNPVATAQWGCNVAGEGEIMNHALDNHD

SEQ ID NO: 203196 - protein, 39 aa, Artificial Sequence
  Description of Artificial Sequence: Synthetic polypeptide
DEEEIRTTNPVAYEGYGQCVCSNWGEDHNQENFNSDTQS

SEQ ID NO: 203197 - protein, 39 aa, Artificial Sequence
  Description of Artificial Sequence: Synthetic polypeptide
DEEEIRTTNPVAYEGYGQCVCSNWGEDHNQENFNSDTQA

SEQ ID NO: 203198 - protein, 39 aa, Artificial Sequence
  Description of Artificial Sequence: Synthetic polypeptide
DEEEIRTTNPVAYEGYGQCVCSNWGEDHNEENFNSDTQA

SEQ ID NO: 203199 - protein, 39 aa, Artificial Sequence
  Description of Artificial Sequence: Synthetic polypeptide
DEEEIRTTNPVAYEGYGQCVCSNWGEDHNAENFNSETQS

SEQ ID NO: 203200 - protein, 38 aa, Artificial Sequence
  Description of Artificial Sequence: Synthetic polypeptide
DEECISTTNPVATEQYGCVCGNWGEDHNAENFNSDTQP

SEQ ID NO: 203201 - protein, 39 aa, Artificial Sequence
  Description of Artificial Sequence: Synthetic polypeptide
DEEEIRTTNPVAYEGYGQCVCSNSGEDHNQENFNSDNQA

SEQ ID NO: 203202 - protein, 39 aa, Artificial Sequence
  Description of Artificial Sequence: Synthetic polypeptide
DEEEIRTTNPVAYEGYGQCVCSNSGEDHNAEFFNSDNQS

SEQ ID NO: 203203 - protein, 38 aa, Artificial Sequence
  Description of Artificial Sequence: Synthetic polypeptide
DEACISTTNPVATEGYGCVCSNWGEDHNTENFNSENQA

SEQ ID NO: 203204 - protein, 35 aa, Artificial Sequence
  Description of Artificial Sequence: Synthetic polypeptide
QENEIATTNPVATASWGCVAGKGEEMNAALGDNDK

SEQ ID NO: 203205 - protein, 38 aa, Artificial Sequence
  Description of Artificial Sequence: Synthetic polypeptide
DEECISTTNPVATEGYGCVCSNWGEDHNAENFNSDTQS

SEQ ID NO: 203206 - protein, 38 aa, Artificial Sequence
  Description of Artificial Sequence: Synthetic polypeptide
DDAEISTTNPVATEQYGQCYCSNSGEHNQENFNSDNQS

SEQ ID NO: 203207 - protein, 38 aa, Artificial Sequence
  Description of Artificial Sequence: Synthetic polypeptide
DEECISTTNPVATEGYGCVCSNWEEDHNIENFNSDNQA

SEQ ID NO: 203208 - protein, 39 aa, Artificial Sequence
  Description of Artificial Sequence: Synthetic polypeptide
DENEIRTTNPVATEQWGQCVCSNSGEDDNANYSNSDTAS

SEQ ID NO: 203209 - protein, 39 aa, Artificial Sequence
  Description of Artificial Sequence: Synthetic polypeptide
DENEIRTTNPVATEQYGHASCMCAGVDLLQEQVVQEDDT

SEQ ID NO: 203210 - protein, 39 aa, Artificial Sequence
  Description of Artificial Sequence: Synthetic polypeptide
CEEEISTTNPVATEGYGQCVCSNWGEDDNQENFGSDNQP

SEQ ID NO: 203211 - protein, 38 aa, Artificial Sequence
  Description of Artificial Sequence: Synthetic polypeptide
DENEIRTTNPVATEQWGQCVCSNSGPDNAENFSSDTAS

SEQ ID NO: 203212 - protein, 34 aa, Artificial Sequence
  Description of Artificial Sequence: Synthetic polypeptide
DDSCVASTNPVSTEGYGCVCQTWEIQERFGSQQS

SEQ ID NO: 203213 - protein, 33 aa, Artificial Sequence
  Description of Artificial Sequence: Synthetic polypeptide
DDSCVASTNPVSTEGYGCVCGTWEIQEYFGSQQ

SEQ ID NO: 203214 - protein, 38 aa, Artificial Sequence
  Description of Artificial Sequence: Synthetic polypeptide
DDEEISTTNPVAYEQYGQCVCSNWEEHNAENFGSDTQA

SEQ ID NO: 203215 - protein, 38 aa, Artificial Sequence
  Description of Artificial Sequence: Synthetic polypeptide
DESEIRTTNCVATEAYGAVGNNAGDDTDGEQGGMEGAE

SEQ ID NO: 203216 - protein, 39 aa, Artificial Sequence
  Description of Artificial Sequence: Synthetic polypeptide
DEMEISTTNPVATEQYGQCVCSNWGEDHNAEFFNSDNQS

SEQ ID NO: 203217 - protein, 37 aa, Artificial Sequence
  Description of Artificial Sequence: Synthetic polypeptide
QENEIATTNCVATEQYGVVAGPGEGEGGQGGNQGEDT

SEQ ID NO: 203218 - protein, 36 aa, Artificial Sequence
  Description of Artificial Sequence: Synthetic polypeptide
DDSCIRCTNPVATECYGSYSYAVHPHITFEGTEDRL

SEQ ID NO: 203219 - protein, 39 aa, Artificial Sequence
  Description of Artificial Sequence: Synthetic polypeptide
DEMEISTTNPVATEQYGQCVCSNWGEDHNAEFFNSDTQS

SEQ ID NO: 203220 - protein, 39 aa, Artificial Sequence
  Description of Artificial Sequence: Synthetic polypeptide
DEMEISTTNPVATEQYGQCVCSNWGEDHNAENFISENQS

SEQ ID NO: 203221 - protein, 38 aa, Artificial Sequence
  Description of Artificial Sequence: Synthetic polypeptide
CEEEISTTNPVATEGYGQCVCSNWGEHNAENFNSDTQA

SEQ ID NO: 203222 - protein, 38 aa, Artificial Sequence
  Description of Artificial Sequence: Synthetic polypeptide
CEEEISTTNPVATEQWGQCVCSNWGEDNEEFFNSDTQE

SEQ ID NO: 203223 - protein, 38 aa, Artificial Sequence
  Description of Artificial Sequence: Synthetic polypeptide
DEAEISTTNPVATEQYGCVCSNWGEDHNAENFISETQA

SEQ ID NO: 203224 - protein, 39 aa, Artificial Sequence
  Description of Artificial Sequence: Synthetic polypeptide
DEMEISTTNPVATEQYGQCVCSNWGEDHNAENFNSDNQA

SEQ ID NO: 203225 - protein, 38 aa, Artificial Sequence
  Description of Artificial Sequence: Synthetic polypeptide
DENEIRTTNPVATEQWGQCVCSNWGEDNTEYFISDTAS

SEQ ID NO: 203226 - protein, 38 aa, Artificial Sequence
  Description of Artificial Sequence: Synthetic polypeptide
DDAEISTTNPVATEQYGQCVCSNWGEHNAEHFNSDTQL

SEQ ID NO: 203227 - protein, 38 aa, Artificial Sequence
  Description of Artificial Sequence: Synthetic polypeptide
DEECISTTNPVATEQYGCVCSNWGEDHNQENFISETQA

SEQ ID NO: 203228 - protein, 37 aa, Artificial Sequence
  Description of Artificial Sequence: Synthetic polypeptide
DEEACEIAATNPVAYEPWGVCAMWINDQAADGRAGNM

SEQ ID NO: 203229 - protein, 38 aa, Artificial Sequence
  Description of Artificial Sequence: Synthetic polypeptide
DEDQIATTNPVAYEQWGSVCSAANPPAPEAHGGDNEAM

SEQ ID NO: 203230 - protein, 37 aa, Artificial Sequence
  Description of Artificial Sequence: Synthetic polypeptide
DEDSIACTNPVATEQWGHSVSAMWPAGDNQGNPMEPV

SEQ ID NO: 203231 - protein, 37 aa, Artificial Sequence
  Description of Artificial Sequence: Synthetic polypeptide
DEDTAATTNPVAYEQWGSVSGGEPGNGGNMRNKMEMM

SEQ ID NO: 203232 - protein, 40 aa, Artificial Sequence
  Description of Artificial Sequence: Synthetic polypeptide
DEDTICTTNPVATEQYGVVVVVTVNNNQQGNNDEQGNAGG

SEQ ID NO: 203233 - protein, 37 aa, Artificial Sequence
  Description of Artificial Sequence: Synthetic polypeptide
DEMEISTTNPVAYEQWGCVCSNWGEPNAEFFGSDTQA

SEQ ID NO: 203234 - protein, 39 aa, Artificial Sequence
  Description of Artificial Sequence: Synthetic polypeptide
DENEIRTTNPVATEQYGNASCMCAGVDLLQEVMVQEDDN

SEQ ID NO: 203235 - protein, 38 aa, Artificial Sequence
  Description of Artificial Sequence: Synthetic polypeptide
DDEEISTTNPVAYEQYGCVCSNWGEDHNEENFGSDTQA

SEQ ID NO: 203236 - protein, 33 aa, Artificial Sequence
  Description of Artificial Sequence: Synthetic polypeptide
DDSEIASTNPIATEGYGATTWANADWASPKGPI

SEQ ID NO: 203237 - protein, 37 aa, Artificial Sequence
  Description of Artificial Sequence: Synthetic polypeptide
DEEACEIAATNPVAYEPWGVCAMWINDQQLDGRNGNM

SEQ ID NO: 203238 - protein, 33 aa, Artificial Sequence
  Description of Artificial Sequence: Synthetic polypeptide
DEDTNATTNPVAYEQWGCTYCNWIDLHGEDDSP

SEQ ID NO: 203239 - protein, 35 aa, Artificial Sequence
  Description of Artificial Sequence: Synthetic polypeptide
CEEEIACTNPVATAQWGCIAITGANPPAEAPMGQA

SEQ ID NO: 203240 - protein, 39 aa, Artificial Sequence
  Description of Artificial Sequence: Synthetic polypeptide
SEEEIRGTNPVATEQYGQVSVVDIMGMEMDQENVGGGDG

SEQ ID NO: 203241 - protein, 39 aa, Artificial Sequence
  Description of Artificial Sequence: Synthetic polypeptide
SEEEIRGTNPVATEQYGCVNVPCESFEMHEFNTVPNGDF

SEQ ID NO: 203242 - protein, 39 aa, Artificial Sequence
  Description of Artificial Sequence: Synthetic polypeptide
DENEIRTTNPVATEQYGMIGNSDDDDEMDQGGGGIQEQT

SEQ ID NO: 203243 - protein, 38 aa, Artificial Sequence
  Description of Artificial Sequence: Synthetic polypeptide
DDAEISTTNPVATEQYGQCVCSNWEEDNEENFNSDTQM

SEQ ID NO: 203244 - protein, 35 aa, Artificial Sequence
  Description of Artificial Sequence: Synthetic polypeptide
CEEEIACTNPVATAQWGCCNATGANPPAEAPMGQA

SEQ ID NO: 203245 - protein, 35 aa, Artificial Sequence
  Description of Artificial Sequence: Synthetic polypeptide
QSEEIATTNPVGYEHWGCVRHNNDKQQDRRPEDMR

SEQ ID NO: 203246 - protein, 37 aa, Artificial Sequence
  Description of Artificial Sequence: Synthetic polypeptide
DEEACEIAATNPVAYEPWGVCAMWINDHQSDGRNGNN

SEQ ID NO: 203247 - protein, 38 aa, Artificial Sequence
  Description of Artificial Sequence: Synthetic polypeptide
DDAEISTTNPVATEQYGQCVCSNWEEDNAENFNSDNQA

SEQ ID NO: 203248 - protein, 38 aa, Artificial Sequence
  Description of Artificial Sequence: Synthetic polypeptide
DEMEIACTNPVATEQYGQCVCSNWGEPNAEFFNSDTQA

SEQ ID NO: 203249 - protein, 37 aa, Artificial Sequence
  Description of Artificial Sequence: Synthetic polypeptide
QTSEIAPTNPCSYEQYGVTVSCEWNMLSQNSNGGTNR

SEQ ID NO: 203250 - protein, 38 aa, Artificial Sequence
  Description of Artificial Sequence: Synthetic polypeptide
DDEEISTTNPVAYEQYGQCVCSNWGEDNQENFGSEFQG

SEQ ID NO: 203251 - protein, 38 aa, Artificial Sequence
  Description of Artificial Sequence: Synthetic polypeptide
DEAEISTTNPVATEQYGCVCSNWGEDHNAEYFISDTQS

SEQ ID NO: 203252 - protein, 37 aa, Artificial Sequence
  Description of Artificial Sequence: Synthetic polypeptide
DEACISTTNPVATEEYGCVCENWGEPNAEYFGSDNQA

SEQ ID NO: 203253 - protein, 39 aa, Artificial Sequence
  Description of Artificial Sequence: Synthetic polypeptide
DDAEISTTNPVATEQYGQCVCSTWGEDHNAENFNSDFQS

SEQ ID NO: 203254 - protein, 38 aa, Artificial Sequence
  Description of Artificial Sequence: Synthetic polypeptide
DDEEISTTNPVAYEQYGQCVCSNWGEHNAESFNSDTQP

SEQ ID NO: 203255 - protein, 39 aa, Artificial Sequence
  Description of Artificial Sequence: Synthetic polypeptide
AEEEISTTNPVATEQYGQCIVCSNWMEHNTENFNSETQS

SEQ ID NO: 203256 - protein, 38 aa, Artificial Sequence
  Description of Artificial Sequence: Synthetic polypeptide
DDEEISTTNPVAYEQYGQCVCSNWGEHNQENFGSETQA

SEQ ID NO: 203257 - protein, 39 aa, Artificial Sequence
  Description of Artificial Sequence: Synthetic polypeptide
DDEEISTTNPVAYEQYGQCVCSNWMEDHNAEYFGSQNQA

SEQ ID NO: 203258 - protein, 39 aa, Artificial Sequence
  Description of Artificial Sequence: Synthetic polypeptide
DDEEISTTNPVAYEQYGQCVCSTWGEDTNAENFNSETQS

SEQ ID NO: 203259 - protein, 38 aa, Artificial Sequence
  Description of Artificial Sequence: Synthetic polypeptide
DDAEISTTNPVATEQYGQCVCSNWGEHNQEYFNSDTQS

SEQ ID NO: 203260 - protein, 38 aa, Artificial Sequence
  Description of Artificial Sequence: Synthetic polypeptide
DEMAISTTNPVATEQYGQCFCSWGEDHNIENFGSDNQA

SEQ ID NO: 203261 - protein, 38 aa, Artificial Sequence
  Description of Artificial Sequence: Synthetic polypeptide
SAEEIATTNPVATEQYGSVCAMANHADESKMPDGSLHN

SEQ ID NO: 203262 - protein, 38 aa, Artificial Sequence
  Description of Artificial Sequence: Synthetic polypeptide
DEMEISTTNPVATEQYGQCVCSNWGEDNAENFSSDTQA

SEQ ID NO: 203263 - protein, 39 aa, Artificial Sequence
  Description of Artificial Sequence: Synthetic polypeptide
AEEEISTTNPVATEQYGQCQVCSNWGEHNAENFNSDTQA

SEQ ID NO: 203264 - protein, 37 aa, Artificial Sequence
  Description of Artificial Sequence: Synthetic polypeptide
SAEEIATTNPVATEQYGSVCAMANHADDSKAPPDSEN

SEQ ID NO: 203265 - protein, 38 aa, Artificial Sequence
  Description of Artificial Sequence: Synthetic polypeptide
DDAEISTTNPVATEQYGQCVCSWGEDHNQESFGSDTQA

SEQ ID NO: 203266 - protein, 38 aa, Artificial Sequence
  Description of Artificial Sequence: Synthetic polypeptide
SAEEIATTNPVATEQYGSVCAMANHADDSKAPGDSFEH

SEQ ID NO: 203267 - protein, 38 aa, Artificial Sequence
  Description of Artificial Sequence: Synthetic polypeptide
DEECISTTNPVATEGYGCVCSNWGEDHNAENFNSDFQL

SEQ ID NO: 203268 - protein, 39 aa, Artificial Sequence
  Description of Artificial Sequence: Synthetic polypeptide
DEEAIRTTNPVATEGYGQCVCSNWEEDHNAENFNSDNQG

SEQ ID NO: 203269 - protein, 37 aa, Artificial Sequence
  Description of Artificial Sequence: Synthetic polypeptide
DDEEISTTNPVGTEQWGCVCSWGEDHNAENFNSVTQA

SEQ ID NO: 203270 - protein, 38 aa, Artificial Sequence
  Description of Artificial Sequence: Synthetic polypeptide
DDAEISTTNPVATEQYGQCVCSNWGEHNAEYFNSDTQS

SEQ ID NO: 203271 - protein, 38 aa, Artificial Sequence
  Description of Artificial Sequence: Synthetic polypeptide
DDAEISTTNPVATEQYGQCVCSNWGEHNAENFNSDTQA

SEQ ID NO: 203272 - protein, 38 aa, Artificial Sequence
  Description of Artificial Sequence: Synthetic polypeptide
DDEEISTTNPVAYEQYGQCVCSNWGEHNAESFNSDTQA

SEQ ID NO: 203273 - protein, 39 aa, Artificial Sequence
  Description of Artificial Sequence: Synthetic polypeptide
DEMEIACTNPVATEQYGQCVCSNWGEDDNAEHFGSENQA

SEQ ID NO: 203274 - protein, 38 aa, Artificial Sequence
  Description of Artificial Sequence: Synthetic polypeptide
DDAEISTTNPVATEQYGQCVCSNWGEHNAENFGSDTQS

SEQ ID NO: 203275 - protein, 38 aa, Artificial Sequence
  Description of Artificial Sequence: Synthetic polypeptide
DDAEISTTNPVATEQYGQCVCSNWGEHNAENFISDNQN

SEQ ID NO: 203276 - protein, 39 aa, Artificial Sequence
  Description of Artificial Sequence: Synthetic polypeptide
DEMEISTTNPVATEQYGQCVCSNWGEDHNAENFNSDNQF

SEQ ID NO: 203277 - protein, 38 aa, Artificial Sequence
  Description of Artificial Sequence: Synthetic polypeptide
DQEEISTTNPVATCQYGCVCQNWGEGHNAENFGSDNQA

SEQ ID NO: 203278 - protein, 38 aa, Artificial Sequence
  Description of Artificial Sequence: Synthetic polypeptide
DQEEISTTNPVATCQYGCVCSNWGEDDNAENFGSDTQS

SEQ ID NO: 203279 - protein, 38 aa, Artificial Sequence
  Description of Artificial Sequence: Synthetic polypeptide
DQEEISTTNPVATCQYGCVCSNWGEGHNQENFGSQTQS

SEQ ID NO: 203280 - protein, 38 aa, Artificial Sequence
  Description of Artificial Sequence: Synthetic polypeptide
DDEEISTTNPVAYEQYGQCVCSNWGEHNAEGSNSDTQS

SEQ ID NO: 203281 - protein, 38 aa, Artificial Sequence
  Description of Artificial Sequence: Synthetic polypeptide
DDEEISTTNPVAYEQYGQCVCSNWGEHNAEHFNSDTQN

SEQ ID NO: 203282 - protein, 38 aa, Artificial Sequence
  Description of Artificial Sequence: Synthetic polypeptide
DDEEISTTNPVAYEQYGQCVCSNWGEHNAENFGSDTQP

SEQ ID NO: 203283 - protein, 39 aa, Artificial Sequence
  Description of Artificial Sequence: Synthetic polypeptide
DEMEISTTNPVATEQYGQCVCSNWGEDHNAENFNSDTQA

SEQ ID NO: 203284 - protein, 39 aa, Artificial Sequence
  Description of Artificial Sequence: Synthetic polypeptide
DEMEISTTNPVATEQYGQCVCSNWGEDHNEENFGSETQS

SEQ ID NO: 203285 - protein, 37 aa, Artificial Sequence
  Description of Artificial Sequence: Synthetic polypeptide
SAEEIATTNPVATEQYGSVCAMANHADNSKAPDSLHN

SEQ ID NO: 203286 - protein, 39 aa, Artificial Sequence
  Description of Artificial Sequence: Synthetic polypeptide
DQEEISTTNPVATEQYGQCVCSNWGEDHNAENFNSDTQS

SEQ ID NO: 203287 - protein, 39 aa, Artificial Sequence
  Description of Artificial Sequence: Synthetic polypeptide
DEMEISTTNPVATEQYGQCVCSNWGEDHNIENFNSETQS

SEQ ID NO: 203288 - protein, 38 aa, Artificial Sequence
  Description of Artificial Sequence: Synthetic polypeptide
DDEEISTTNPVAYEQYGQCVCSNWGEHNAENFQSDTQP

SEQ ID NO: 203289 - protein, 37 aa, Artificial Sequence
  Description of Artificial Sequence: Synthetic polypeptide
DEAEEATTNPVAYEPWGVVVHTDQGLQDDKHGGGERK

SEQ ID NO: 203290 - protein, 37 aa, Artificial Sequence
  Description of Artificial Sequence: Synthetic polypeptide
DEACISTTNPLATEQWGCVCSNWGEDNAESFGSDNQS

SEQ ID NO: 203291 - protein, 39 aa, Artificial Sequence
  Description of Artificial Sequence: Synthetic polypeptide
DEMEISTTNPVATEQYGQCVCSNWGEDHNTEHFNSETQA

SEQ ID NO: 203292 - protein, 38 aa, Artificial Sequence
  Description of Artificial Sequence: Synthetic polypeptide
CEECISTTNPVATEQYGQCVCSNWGEHNAENFGSDTQA

SEQ ID NO: 203293 - protein, 38 aa, Artificial Sequence
  Description of Artificial Sequence: Synthetic polypeptide
DEEEIRTTNPCATEEYGQCVCGNWGEHNAENFGSDTQA

SEQ ID NO: 203294 - protein, 37 aa, Artificial Sequence
  Description of Artificial Sequence: Synthetic polypeptide
CEEEISTTNPVAYEEYGQCVCSWGEHNAENFISDNQS

SEQ ID NO: 203295 - protein, 34 aa, Artificial Sequence
  Description of Artificial Sequence: Synthetic polypeptide
QENEIATTNPVATASWGCVAGKGEEMNADLDNDD

SEQ ID NO: 203296 - protein, 38 aa, Artificial Sequence
  Description of Artificial Sequence: Synthetic polypeptide
DEQEIRSTNPVATEAYGVVMSNNDNNTEGPGQTDQTGD

SEQ ID NO: 203297 - protein, 39 aa, Artificial Sequence
  Description of Artificial Sequence: Synthetic polypeptide
DENEIRTTNPVATEQYGAASCMCAGVDLLIEVGVQEDDN

SEQ ID NO: 203298 - protein, 38 aa, Artificial Sequence
  Description of Artificial Sequence: Synthetic polypeptide
DEACISTTNPVATEQYGQCVCSNWGEHNQENFNSENQI

SEQ ID NO: 203299 - protein, 39 aa, Artificial Sequence
  Description of Artificial Sequence: Synthetic polypeptide
AEEEISTTNPVATEQYGQCVCSNWGEDHNAENFNSDNQE

SEQ ID NO: 203300 - protein, 39 aa, Artificial Sequence
  Description of Artificial Sequence: Synthetic polypeptide
DEEAISTTNPVATEQYGCIVCSNWGEDHNTENFNSETQA

SEQ ID NO: 203301 - protein, 39 aa, Artificial Sequence
  Description of Artificial Sequence: Synthetic polypeptide
DENEIRTTNPVATEQYGAASCMCAGVDLLQEEVVQEDMN

SEQ ID NO: 203302 - protein, 38 aa, Artificial Sequence
  Description of Artificial Sequence: Synthetic polypeptide
DDMEISTTNPVATEQYGQCVCSNWGEDHNEENFNSDQM

SEQ ID NO: 203303 - protein, 39 aa, Artificial Sequence
  Description of Artificial Sequence: Synthetic polypeptide
DENEIRTTNPVATEQYGAASCMCAGVDLLQEIVEQEDDS

SEQ ID NO: 203304 - protein, 39 aa, Artificial Sequence
  Description of Artificial Sequence: Synthetic polypeptide
DENEIRTTNPVATEQYGAASCMCAAVDLLQEVTVQEDYN

SEQ ID NO: 203305 - protein, 36 aa, Artificial Sequence
  Description of Artificial Sequence: Synthetic polypeptide
DESEIQTTNPMAYEAWGISVPVNANSSPDREGGMVC

SEQ ID NO: 203306 - protein, 38 aa, Artificial Sequence
  Description of Artificial Sequence: Synthetic polypeptide
DEQEIRSTNPVATDQYGVVNDNSIGQNGGQEDTDDTDG

SEQ ID NO: 203307 - protein, 38 aa, Artificial Sequence
  Description of Artificial Sequence: Synthetic polypeptide
CEEEISTTNPVAYEQYGCVCSNWGEDHNQENFGSDTQA

SEQ ID NO: 203308 - protein, 39 aa, Artificial Sequence
  Description of Artificial Sequence: Synthetic polypeptide
DEAEISTTNPVATEQYGQCVCSNWGEDDNAENFNSDTQS

SEQ ID NO: 203309 - protein, 39 aa, Artificial Sequence
  Description of Artificial Sequence: Synthetic polypeptide
DENEIRTTNPVATEQYGASSCEYMWAPTLHNDEYAFKEH

SEQ ID NO: 203310 - protein, 38 aa, Artificial Sequence
  Description of Artificial Sequence: Synthetic polypeptide
DDMEISTTNPVATEQYGCVCSNWGEDHNQENFNSDTQS

SEQ ID NO: 203311 - protein, 37 aa, Artificial Sequence
  Description of Artificial Sequence: Synthetic polypeptide
CEEEISTTNPVAYEQYGCVCSNWGEHNAENFISDTQS

SEQ ID NO: 203312 - protein, 38 aa, Artificial Sequence
  Description of Artificial Sequence: Synthetic polypeptide
DDMEISTTNPVATEQYGCVCSNWGEDHNAENSNSENQS

SEQ ID NO: 203313 - protein, 38 aa, Artificial Sequence
  Description of Artificial Sequence: Synthetic polypeptide
DDMEISTTNPVATEQYGCVCSNWGEDHNAENFNSDNQA

SEQ ID NO: 203314 - protein, 39 aa, Artificial Sequence
  Description of Artificial Sequence: Synthetic polypeptide
DENEIRTTNPVATEQYGAASCMCAYVDLLQEQVVQEDDQ

SEQ ID NO: 203315 - protein, 38 aa, Artificial Sequence
  Description of Artificial Sequence: Synthetic polypeptide
DDMEISTTNPVATEQYGCVCSMWGEDHNAENFNSDNQS

SEQ ID NO: 203316 - protein, 39 aa, Artificial Sequence
  Description of Artificial Sequence: Synthetic polypeptide
DENEIRTTNPVATEQYGAASAMCAGVDLLQHVTVQEDDN

SEQ ID NO: 203317 - protein, 39 aa, Artificial Sequence
  Description of Artificial Sequence: Synthetic polypeptide
AEEEISTTNPVATEQYGQCVCSNWGEDHNAENFGSDTQS

SEQ ID NO: 203318 - protein, 38 aa, Artificial Sequence
  Description of Artificial Sequence: Synthetic polypeptide
DEEAISTTNPVATEGYGQCVCSNWGEHNAENFNSDFQF

SEQ ID NO: 203319 - protein, 35 aa, Artificial Sequence
  Description of Artificial Sequence: Synthetic polypeptide
DEQEIRTTNPIATECWGATTWANAEDWAEPKGPYI

SEQ ID NO: 203320 - protein, 38 aa, Artificial Sequence
  Description of Artificial Sequence: Synthetic polypeptide
DEACISTTNPVATEQYGQCVCSNWGEHNAENFNSDTQA

SEQ ID NO: 203321 - protein, 38 aa, Artificial Sequence
  Description of Artificial Sequence: Synthetic polypeptide
DEEAISTTNPVATEGYGQCVCSNWGEHNQENFGSDTQP

SEQ ID NO: 203322 - protein, 35 aa, Artificial Sequence
  Description of Artificial Sequence: Synthetic polypeptide
DEQEIRTTNPIATECWGATTWANAEDWAEPKGPEI

SEQ ID NO: 203323 - protein, 38 aa, Artificial Sequence
  Description of Artificial Sequence: Synthetic polypeptide
DEACISTTNPVATEQYGQCVCSNWGEHNAENFNSDTQQ

SEQ ID NO: 203324 - protein, 38 aa, Artificial Sequence
  Description of Artificial Sequence: Synthetic polypeptide
DEACISTTNPVATEQYGQCVCSNWGEHNAENFNSDTQS

SEQ ID NO: 203325 - protein, 38 aa, Artificial Sequence
  Description of Artificial Sequence: Synthetic polypeptide
DEECISTTNPVATEGYGQCVCSNWGEHNAENFGSDTQS

SEQ ID NO: 203326 - protein, 38 aa, Artificial Sequence
  Description of Artificial Sequence: Synthetic polypeptide
DEACISTTNPVATEQYGQCVCSNWGEHNAENFNSQNQA

SEQ ID NO: 203327 - protein, 38 aa, Artificial Sequence
  Description of Artificial Sequence: Synthetic polypeptide
DEAEISTTNPVATEQYGQCICSNWGEHNQESFNSDNQP

SEQ ID NO: 203328 - protein, 39 aa, Artificial Sequence
  Description of Artificial Sequence: Synthetic polypeptide
AEEEISTTNPVATEQYGQCVCSNWGEDHNAEHFNSDTQA

SEQ ID NO: 203329 - protein, 39 aa, Artificial Sequence
  Description of Artificial Sequence: Synthetic polypeptide
DEEEIRTTNPVATEQWGQCVCSNWMYDHNAENFISETQS

SEQ ID NO: 203330 - protein, 39 aa, Artificial Sequence
  Description of Artificial Sequence: Synthetic polypeptide
AEEEISTTNPVATEQYGQCVCSNWGEDHNIENFNSDTQG

SEQ ID NO: 203331 - protein, 39 aa, Artificial Sequence
  Description of Artificial Sequence: Synthetic polypeptide
AEEEISTTNPVATEQYGQCVCSNWGEDHNAENFGSDTQA

SEQ ID NO: 203332 - protein, 39 aa, Artificial Sequence
  Description of Artificial Sequence: Synthetic polypeptide
DEAEISTTNPVATEQYGQCIVCSNSGEHNTENFNSETQA

SEQ ID NO: 203333 - protein, 39 aa, Artificial Sequence
  Description of Artificial Sequence: Synthetic polypeptide
DEAEISTTNPVATEQYGQCTCSNWGEDHNAENFGSDNQS

SEQ ID NO: 203334 - protein, 39 aa, Artificial Sequence
  Description of Artificial Sequence: Synthetic polypeptide
DEEEIRTTNPVCTEHYGQCVCSNWGEDHNAENFNSDTQS

SEQ ID NO: 203335 - protein, 39 aa, Artificial Sequence
  Description of Artificial Sequence: Synthetic polypeptide
DEAEISTTNPVATEQYGQCVCGNSGEDHNQENFNSDTQS

SEQ ID NO: 203336 - protein, 36 aa, Artificial Sequence
  Description of Artificial Sequence: Synthetic polypeptide
DEIAEIATTNPVAYEAWGVVWPGPNNENDDGQGGSE

SEQ ID NO: 203337 - protein, 38 aa, Artificial Sequence
  Description of Artificial Sequence: Synthetic polypeptide
DEEAISTTNPVATEQYGCVCGNWGEDHNAENFNSDTQS

SEQ ID NO: 203338 - protein, 40 aa, Artificial Sequence
  Description of Artificial Sequence: Synthetic polypeptide
DEEEIRTTNPVATEQWGICQVCSYWGEDHNAEYFNSDTQA

SEQ ID NO: 203339 - protein, 37 aa, Artificial Sequence
  Description of Artificial Sequence: Synthetic polypeptide
CEEEISTTNPVAYEQYGCVCSNWGEHNQENFFSDTQA

SEQ ID NO: 203340 - protein, 39 aa, Artificial Sequence
  Description of Artificial Sequence: Synthetic polypeptide
CEEEISTTNPVAYEQYGQCVCSNWGEDDNAENFGSDNQS

SEQ ID NO: 203341 - protein, 39 aa, Artificial Sequence
  Description of Artificial Sequence: Synthetic polypeptide
DEAEISTTNPVATEQYGQCVCGTWGEDHNAENFNSDTQS

SEQ ID NO: 203342 - protein, 39 aa, Artificial Sequence
  Description of Artificial Sequence: Synthetic polypeptide
DENEIRTTNPVATEQYGAASCMCMGVDLLQEVVVQEDDN

SEQ ID NO: 203343 - protein, 39 aa, Artificial Sequence
  Description of Artificial Sequence: Synthetic polypeptide
DEAEISTTNPVATEQYGQCVCSMWGEDHNAEYFNSDTQS

SEQ ID NO: 203344 - protein, 38 aa, Artificial Sequence
  Description of Artificial Sequence: Synthetic polypeptide
DDMEIATTNPVATEGYGQCVCSNWGEHNAEHFGSENQS

SEQ ID NO: 203345 - protein, 38 aa, Artificial Sequence
  Description of Artificial Sequence: Synthetic polypeptide
DESEIRGTNPVATDQYGAIIVVGGEGNNMNDGGNDQQQ

SEQ ID NO: 203346 - protein, 37 aa, Artificial Sequence
  Description of Artificial Sequence: Synthetic polypeptide
DESEIRGTNPVATDQYGAIIDGGQGNNEMNDGGNDQQ

SEQ ID NO: 203347 - protein, 39 aa, Artificial Sequence
  Description of Artificial Sequence: Synthetic polypeptide
AEEEISTTNPVATEQYGQCVCSNWGEDHNAENFNSDTQA

SEQ ID NO: 203348 - protein, 41 aa, Artificial Sequence
  Description of Artificial Sequence: Synthetic polypeptide
DEEICTICTTNVATEAYGSVSTVGNNTTEETGNLEEGDNIR

SEQ ID NO: 203349 - protein, 40 aa, Artificial Sequence
  Description of Artificial Sequence: Synthetic polypeptide
DENEIRTTNPVATEQYGAASCMCSAGVDLLQPVTVQEDDN

SEQ ID NO: 203350 - protein, 39 aa, Artificial Sequence
  Description of Artificial Sequence: Synthetic polypeptide
AEEEISTTNPVATEQYGQCVCSNWGEDHNAENSNSDTQQ

SEQ ID NO: 203351 - protein, 39 aa, Artificial Sequence
  Description of Artificial Sequence: Synthetic polypeptide
AEEEISTTNPVATEQYGQCVCSNWGEDHNAEYFNSETQF

SEQ ID NO: 203352 - protein, 39 aa, Artificial Sequence
  Description of Artificial Sequence: Synthetic polypeptide
AEEEISTTNPVATEQYGQCVCSNWGEDHNIENFNSDNQA

SEQ ID NO: 203353 - protein, 38 aa, Artificial Sequence
  Description of Artificial Sequence: Synthetic polypeptide
DDAEISTTNPVAYEQYGCVCSNWGEDHNTENSNSENQS

SEQ ID NO: 203354 - protein, 39 aa, Artificial Sequence
  Description of Artificial Sequence: Synthetic polypeptide
AEEEISTTNPVATEQYGQCVCSNWGEDHNEEHFNSDTQS

SEQ ID NO: 203355 - protein, 38 aa, Artificial Sequence
  Description of Artificial Sequence: Synthetic polypeptide
DEAEISTTNPVATEQYGQCVCQNWGEHNAENFNSDTQQ

SEQ ID NO: 203356 - protein, 38 aa, Artificial Sequence
  Description of Artificial Sequence: Synthetic polypeptide
DEAEISTTNPVATEQYGQCVCPNWGEHNAENFNSETQN

SEQ ID NO: 203357 - protein, 39 aa, Artificial Sequence
  Description of Artificial Sequence: Synthetic polypeptide
DDMEIATTNPVATEQYGICVCSNWGEDHNAEHFGSENQS

SEQ ID NO: 203358 - protein, 39 aa, Artificial Sequence
  Description of Artificial Sequence: Synthetic polypeptide
AEEEISTTNPVATEQYGQCVCSNWGEDHNAENFNSDTQN

SEQ ID NO: 203359 - protein, 38 aa, Artificial Sequence
  Description of Artificial Sequence: Synthetic polypeptide
DEAEISTTNPVATEQYGQCVCSMWGEHNAENFISDTQS

SEQ ID NO: 203360 - protein, 38 aa, Artificial Sequence
  Description of Artificial Sequence: Synthetic polypeptide
DEMEISTTNPVAYEGYGCVCSNWEEDHNTENFNSDNQS

SEQ ID NO: 203361 - protein, 38 aa, Artificial Sequence
  Description of Artificial Sequence: Synthetic polypeptide
DEEAISTTNPVATEQYGCVCSNWGEDHNAENFISDTQS

SEQ ID NO: 203362 - protein, 37 aa, Artificial Sequence
  Description of Artificial Sequence: Synthetic polypeptide
AENEIACTNPVATEQYGCSCSWGEADNIEYFNSDTQA

SEQ ID NO: 203363 - protein, 39 aa, Artificial Sequence
  Description of Artificial Sequence: Synthetic polypeptide
DEAEISTTNPVATEQYGQCVCSNWGEDDNAENFNSDTQP

SEQ ID NO: 203364 - protein, 39 aa, Artificial Sequence
  Description of Artificial Sequence: Synthetic polypeptide
DEAEISTTNPVATEQYGQCVCSNWGEDDNAENFNSDNQS

SEQ ID NO: 203365 - protein, 39 aa, Artificial Sequence
  Description of Artificial Sequence: Synthetic polypeptide
CEECIRTTNPVATEQYGQCVCSNWGEDDNEENFNSDTQS

SEQ ID NO: 203366 - protein, 38 aa, Artificial Sequence
  Description of Artificial Sequence: Synthetic polypeptide
CEEEISTTNPVAYEQYGQCVCSNWGEHNAENFGSQTQS

SEQ ID NO: 203367 - protein, 39 aa, Artificial Sequence
  Description of Artificial Sequence: Synthetic polypeptide
CEEEISTTNPVAYEQYGQCVCSNWGEDTNAENFNSDNQS

SEQ ID NO: 203368 - protein, 37 aa, Artificial Sequence
  Description of Artificial Sequence: Synthetic polypeptide
AENEIACTNPVATEQYGCSCSWGEAHNAENFGSQTQS

SEQ ID NO: 203369 - protein, 39 aa, Artificial Sequence
  Description of Artificial Sequence: Synthetic polypeptide
DEAEISTTNPVATEQYGQCVCSNWEEDDNAENFNSDTQS

SEQ ID NO: 203370 - protein, 39 aa, Artificial Sequence
  Description of Artificial Sequence: Synthetic polypeptide
DEAEISTTNPVATEQYGQCVCSNWEEDDNAENFNSDNQS

SEQ ID NO: 203371 - protein, 39 aa, Artificial Sequence
  Description of Artificial Sequence: Synthetic polypeptide
DEAEISTTNPVATEQYGQCVCSNWEEDDNAEFFNSDNQA

SEQ ID NO: 203372 - protein, 38 aa, Artificial Sequence
  Description of Artificial Sequence: Synthetic polypeptide
DEAEISTTNPVATEQYGQCVCSNSGEHNAENFISDTQS

SEQ ID NO: 203373 - protein, 38 aa, Artificial Sequence
  Description of Artificial Sequence: Synthetic polypeptide
DEAEISTTNPVATEQYGQCVCGNWGEHNAENFNSENQA

SEQ ID NO: 203374 - protein, 39 aa, Artificial Sequence
  Description of Artificial Sequence: Synthetic polypeptide
DEAEISTTNPVATEQYGQCVCSNSGEGHNAENFNSDTQS

SEQ ID NO: 203375 - protein, 37 aa, Artificial Sequence
  Description of Artificial Sequence: Synthetic polypeptide
CEEEIACTNPVATEQYGQACAAANPAEADAEIGENTA

SEQ ID NO: 203376 - protein, 39 aa, Artificial Sequence
  Description of Artificial Sequence: Synthetic polypeptide
DEAEISTTNPVATEQYGQCVCSNSGEDHNAENFGSDTQA

SEQ ID NO: 203377 - protein, 39 aa, Artificial Sequence
  Description of Artificial Sequence: Synthetic polypeptide
DEAEISTTNPVATEQYGQCVCSNSGEDHNAEHFNSDTQN

SEQ ID NO: 203378 - protein, 39 aa, Artificial Sequence
  Description of Artificial Sequence: Synthetic polypeptide
DEAEISTTNPVATEQYGQCVCSMWPEDHNAEFFNSDTQS

SEQ ID NO: 203379 - protein, 38 aa, Artificial Sequence
  Description of Artificial Sequence: Synthetic polypeptide
DESEIRGTNPVATEAYGVVMEMQDDNLGVNEFGGQTTF

SEQ ID NO: 203380 - protein, 38 aa, Artificial Sequence
  Description of Artificial Sequence: Synthetic polypeptide
DEECISTTNPVATEGYGQCVCSNWEEHNAENFNSDTQS

SEQ ID NO: 203381 - protein, 35 aa, Artificial Sequence
  Description of Artificial Sequence: Synthetic polypeptide
DEQEIRTTNPIATECWGATTWASAEDWAEPKGPYI

SEQ ID NO: 203382 - protein, 33 aa, Artificial Sequence
  Description of Artificial Sequence: Synthetic polypeptide
QEDEIACTNPCSYEQWGITCYCNDQQDHGDDVR

SEQ ID NO: 203383 - protein, 35 aa, Artificial Sequence
  Description of Artificial Sequence: Synthetic polypeptide
DEQEIRTTNPIATECWGATTWSNAEDWAEPEGPYI

SEQ ID NO: 203384 - protein, 37 aa, Artificial Sequence
  Description of Artificial Sequence: Synthetic polypeptide
SAEEIATTNPVATEQWGSCAAAGPALEPDAGTPGDNT

SEQ ID NO: 203385 - protein, 39 aa, Artificial Sequence
  Description of Artificial Sequence: Synthetic polypeptide
AEEEISTTNPVATEQYGQCVCSNWGEDDNAENFNSENQA

SEQ ID NO: 203386 - protein, 39 aa, Artificial Sequence
  Description of Artificial Sequence: Synthetic polypeptide
DEEAISTTNPVATEQYGQCVCSNWGEAHNAENFNSDTQA

SEQ ID NO: 203387 - protein, 38 aa, Artificial Sequence
  Description of Artificial Sequence: Synthetic polypeptide
DDNEIRTTNPVATEQYGTVVIYQTDSEQQPPYSLEVIQ

SEQ ID NO: 203388 - protein, 38 aa, Artificial Sequence
  Description of Artificial Sequence: Synthetic polypeptide
DSEEIRATNPVAYEQWGTFVPANANGEEAPTNQMEGNH

SEQ ID NO: 203389 - protein, 39 aa, Artificial Sequence
  Description of Artificial Sequence: Synthetic polypeptide
DDNEIRTTNPVATEQYGQCVCSNWGEDHNAENFNSDTQG

SEQ ID NO: 203390 - protein, 37 aa, Artificial Sequence
  Description of Artificial Sequence: Synthetic polypeptide
DEEEIATTNPVATEQWGHPACAAANPLAAAPIEDEHQ

SEQ ID NO: 203391 - protein, 33 aa, Artificial Sequence
  Description of Artificial Sequence: Synthetic polypeptide
DESEIRSTNPIGTEGWGVTWANATWAEHKGDYI

SEQ ID NO: 203392 - protein, 39 aa, Artificial Sequence
  Description of Artificial Sequence: Synthetic polypeptide
DEEAISTTNPVATEQYGQCVCSNWEEDHNQENFGSDFQS

SEQ ID NO: 203393 - protein, 34 aa, Artificial Sequence
  Description of Artificial Sequence: Synthetic polypeptide
SAEEIATTNPVATAAWGGCTVAGTGLAAIPDQVM

SEQ ID NO: 203394 - protein, 37 aa, Artificial Sequence
  Description of Artificial Sequence: Synthetic polypeptide
DEECISTTNPVATEIYGCVCGWGEDDNQENFGSDTQS

SEQ ID NO: 203395 - protein, 34 aa, Artificial Sequence
  Description of Artificial Sequence: Synthetic polypeptide
DESEIRSTNPIATEGWGATTWANSDWAEPKGPYI

SEQ ID NO: 203396 - protein, 37 aa, Artificial Sequence
  Description of Artificial Sequence: Synthetic polypeptide
DDNEIRTTNPVATEGWGCVTSNWGEHNTENFISDTAS

SEQ ID NO: 203397 - protein, 39 aa, Artificial Sequence
  Description of Artificial Sequence: Synthetic polypeptide
DEECISTTNPVATEGYGQCVTSTWGADHNAENFGSDTQA

SEQ ID NO: 203398 - protein, 38 aa, Artificial Sequence
  Description of Artificial Sequence: Synthetic polypeptide
QEEEIVTTNPVATEQYGVVMAGPIEGEGGQGEMNENAM

SEQ ID NO: 203399 - protein, 37 aa, Artificial Sequence
  Description of Artificial Sequence: Synthetic polypeptide
AENEIACTNPVATEQYGCSCSNWGEDDNQEYFNSDQA

SEQ ID NO: 203400 - protein, 39 aa, Artificial Sequence
  Description of Artificial Sequence: Synthetic polypeptide
DEEAIRTTNPVAYEQYGQCVCSNWGEDHNAEGFNSETQG

SEQ ID NO: 203401 - protein, 39 aa, Artificial Sequence
  Description of Artificial Sequence: Synthetic polypeptide
DEECISTTNPVATEGYGQCVCSTWGEDHNAENFNSETQS

SEQ ID NO: 203402 - protein, 34 aa, Artificial Sequence
  Description of Artificial Sequence: Synthetic polypeptide
DESEIRSTNPIATECWGATTWANADWAEPKGPYI

SEQ ID NO: 203403 - protein, 38 aa, Artificial Sequence
  Description of Artificial Sequence: Synthetic polypeptide
CEEAISTTNPVATEQYGQCVCSWGEDDNAENFNSDTQS

SEQ ID NO: 203404 - protein, 33 aa, Artificial Sequence
  Description of Artificial Sequence: Synthetic polypeptide
DESEIRSTNPIGTEGWGVTWANATWAEPKGDYI

SEQ ID NO: 203405 - protein, 35 aa, Artificial Sequence
  Description of Artificial Sequence: Synthetic polypeptide
SAEEIAPTNPVAYEQWGCNTAGNGLTTAELGNMDN

SEQ ID NO: 203406 - protein, 35 aa, Artificial Sequence
  Description of Artificial Sequence: Synthetic polypeptide
SAAEIATTNPVAYEQWGCNTAGNNGLTTAEGGNDS

SEQ ID NO: 203407 - protein, 37 aa, Artificial Sequence
  Description of Artificial Sequence: Synthetic polypeptide
DEEEIRTTNPVATEQYGFYCNWPEPPYEDAPEKDIEQ

SEQ ID NO: 203408 - protein, 34 aa, Artificial Sequence
  Description of Artificial Sequence: Synthetic polypeptide
QENEIATTNPVATASWGCVAGKGEEMNAMADNHI

SEQ ID NO: 203409 - protein, 39 aa, Artificial Sequence
  Description of Artificial Sequence: Synthetic polypeptide
AEEEISTTNPVATEQYGQCVCSNWEEDHNAENFNSDTQA

SEQ ID NO: 203410 - protein, 38 aa, Artificial Sequence
  Description of Artificial Sequence: Synthetic polypeptide
DEACISTTNPVATEQYGCVCSNWGEDHNAEFFNSDNQA

SEQ ID NO: 203411 - protein, 39 aa, Artificial Sequence
  Description of Artificial Sequence: Synthetic polypeptide
AEEEISTTNPVATEQYGQCVCSNWEEDHNAENFNSDTQL

SEQ ID NO: 203412 - protein, 39 aa, Artificial Sequence
  Description of Artificial Sequence: Synthetic polypeptide
AEEEISTTNPVATEQYGQCVCSNWEEDHNIENFNSDPQA

SEQ ID NO: 203413 - protein, 38 aa, Artificial Sequence
  Description of Artificial Sequence: Synthetic polypeptide
DEACISTTNPVATEQYGCVCSNWGEDHNAENFNSDTQA

SEQ ID NO: 203414 - protein, 34 aa, Artificial Sequence
  Description of Artificial Sequence: Synthetic polypeptide
QENEIATTNPVATASWGCVAGPGEEMNDALDNDD

SEQ ID NO: 203415 - protein, 39 aa, Artificial Sequence
  Description of Artificial Sequence: Synthetic polypeptide
AEEEISTTNPVATEQYGQCVCSNWGEDDNAENFISENQA

SEQ ID NO: 203416 - protein, 38 aa, Artificial Sequence
  Description of Artificial Sequence: Synthetic polypeptide
CEEAIRTTNPVAYEQYGCVCSNWGEDHNAENFNSDTQA

SEQ ID NO: 203417 - protein, 39 aa, Artificial Sequence
  Description of Artificial Sequence: Synthetic polypeptide
DEEAISTTNPVATEQYGQCVCSNWGEDPNIENFNSDNQN

SEQ ID NO: 203418 - protein, 39 aa, Artificial Sequence
  Description of Artificial Sequence: Synthetic polypeptide
AEEEISTTNPVATEQYGQCVCSNWGEDDNAENFNSDTQA

SEQ ID NO: 203419 - protein, 39 aa, Artificial Sequence
  Description of Artificial Sequence: Synthetic polypeptide
AEEEISTTNPVATEQYGQCVCSNWGEDDNAENFNSDTQG

SEQ ID NO: 203420 - protein, 39 aa, Artificial Sequence
  Description of Artificial Sequence: Synthetic polypeptide
DDNEISTTNPVATEQYGQCVCSNWGEPDNTENFNSDNQS

SEQ ID NO: 203421 - protein, 38 aa, Artificial Sequence
  Description of Artificial Sequence: Synthetic polypeptide
DDNEISTTNPVATEQYGQCVCSNSGEHNAEHFISDNQS

SEQ ID NO: 203422 - protein, 39 aa, Artificial Sequence
  Description of Artificial Sequence: Synthetic polypeptide
AEEEISTTNPVATEQYGQCVCSNWGEDDNAENFNSDTQP

SEQ ID NO: 203423 - protein, 39 aa, Artificial Sequence
  Description of Artificial Sequence: Synthetic polypeptide
DEEAISTTNPVATEQYGQCVCSNWGEDHNAENFGSETQN

SEQ ID NO: 203424 - protein, 39 aa, Artificial Sequence
  Description of Artificial Sequence: Synthetic polypeptide
AEEEISTTNPVATEQYGQCVCSNWGEDDNAENFNSDTQS

SEQ ID NO: 203425 - protein, 39 aa, Artificial Sequence
  Description of Artificial Sequence: Synthetic polypeptide
DEEAISTTNPVATEQYGQCVCSNWGEDHNAEFFGSDTQA

SEQ ID NO: 203426 - protein, 38 aa, Artificial Sequence
  Description of Artificial Sequence: Synthetic polypeptide
DEEAISCTNPVATEQYGCVCSNWGEDHNAENFNSDFQA

SEQ ID NO: 203427 - protein, 38 aa, Artificial Sequence
  Description of Artificial Sequence: Synthetic polypeptide
DEDQIACTNPVATEQWGHSVSAMWPAGTNQGNPMEPVE

SEQ ID NO: 203428 - protein, 38 aa, Artificial Sequence
  Description of Artificial Sequence: Synthetic polypeptide
DEEAISCTNPVATEQYGCVCSNWGEDHNAENFNSETQS

SEQ ID NO: 203429 - protein, 39 aa, Artificial Sequence
  Description of Artificial Sequence: Synthetic polypeptide
DEEAISTTNPVATEQYGQCVCSMWGEDHNAENFNSDTQA

SEQ ID NO: 203430 - protein, 39 aa, Artificial Sequence
  Description of Artificial Sequence: Synthetic polypeptide
AEEEISTTNPVATEQYGQCVCSNWGEDHNQENFGSETQA

SEQ ID NO: 203431 - protein, 39 aa, Artificial Sequence
  Description of Artificial Sequence: Synthetic polypeptide
DEAEISTTNPVATEQYGQCVCSNWGEDHNAEFFNSDTQA

SEQ ID NO: 203432 - protein, 39 aa, Artificial Sequence
  Description of Artificial Sequence: Synthetic polypeptide
DEAEISTTNPVATEQYGQCVCSNWGEDDNAEYFGSDTQS

SEQ ID NO: 203433 - protein, 36 aa, Artificial Sequence
  Description of Artificial Sequence: Synthetic polypeptide
DESEIKTTNPMAYEAWGISVPVNANSSSDREGGMVS

SEQ ID NO: 203434 - protein, 37 aa, Artificial Sequence
  Description of Artificial Sequence: Synthetic polypeptide
DEAEISTVNPVATEGYGCVCSNWGEHNQEYFNSQTQS

SEQ ID NO: 203435 - protein, 37 aa, Artificial Sequence
  Description of Artificial Sequence: Synthetic polypeptide
AENEIACTNPVATEQYGCSCSTWGEDNIEYFISDTQS

SEQ ID NO: 203436 - protein, 38 aa, Artificial Sequence
  Description of Artificial Sequence: Synthetic polypeptide
CEECIRTTNPVAYEQYGQCVCSNWGEHNQENFNSDTQS

SEQ ID NO: 203437 - protein, 38 aa, Artificial Sequence
  Description of Artificial Sequence: Synthetic polypeptide
CEEEISTTNPVAYEQYGCVCSNWGEDDNQEFFNSDTQS

SEQ ID NO: 203438 - protein, 39 aa, Artificial Sequence
  Description of Artificial Sequence: Synthetic polypeptide
DEAEISTTNPVATEQYGQCVCSNWGEDHNAEGFGSETQA

SEQ ID NO: 203439 - protein, 38 aa, Artificial Sequence
  Description of Artificial Sequence: Synthetic polypeptide
CEEEISTTNPVAYEQYGCVCSNWGEDHNAENFGSDTQD

SEQ ID NO: 203440 - protein, 39 aa, Artificial Sequence
  Description of Artificial Sequence: Synthetic polypeptide
AEEEISTTNPVATEQYGQCVCSNWGEDHNAEGFNSDNQP

SEQ ID NO: 203441 - protein, 40 aa, Artificial Sequence
  Description of Artificial Sequence: Synthetic polypeptide
DEAEISTTNPVATEQYGICQVTSTWGADDNAEYFNSDPQS

SEQ ID NO: 203442 - protein, 39 aa, Artificial Sequence
  Description of Artificial Sequence: Synthetic polypeptide
AEEEISTTNPVATEQYGQCVCSNWGEDHNAEGFNSDTQA

SEQ ID NO: 203443 - protein, 39 aa, Artificial Sequence
  Description of Artificial Sequence: Synthetic polypeptide
AEEEISTTNPVATEQYGQCVCSNWGEDHNAEGFNSDTQS

SEQ ID NO: 203444 - protein, 36 aa, Artificial Sequence
  Description of Artificial Sequence: Synthetic polypeptide
DEICEAEICTTNPCVYEQWGCTVTLDNGEHQQNNGS

SEQ ID NO: 203445 - protein, 37 aa, Artificial Sequence
  Description of Artificial Sequence: Synthetic polypeptide
DAEEIATTNPVAYEQYGSVAACPGPAPEAGTPMEDHW

SEQ ID NO: 203446 - protein, 35 aa, Artificial Sequence
  Description of Artificial Sequence: Synthetic polypeptide
DEQEIRTTNPIATECWGATTWSNAEDWAEPKGPYI

SEQ ID NO: 203447 - protein, 38 aa, Artificial Sequence
  Description of Artificial Sequence: Synthetic polypeptide
DEECISTTNPVATEGYGQCVCSNWGEHNAENFNSDTQS

SEQ ID NO: 203448 - protein, 39 aa, Artificial Sequence
  Description of Artificial Sequence: Synthetic polypeptide
AEEEISTTNPVATEQYGQCVCSNWGEDHNAEFFNSDTQS

SEQ ID NO: 203449 - protein, 39 aa, Artificial Sequence
  Description of Artificial Sequence: Synthetic polypeptide
DEAEISTTNPVATEQYGQCVCSNWGEDHNAEHFNSDTQN

SEQ ID NO: 203450 - protein, 36 aa, Artificial Sequence
  Description of Artificial Sequence: Synthetic polypeptide
AENEIACTNPVATEQYGCSCSNWMEHNQNFISDTQA

SEQ ID NO: 203451 - protein, 38 aa, Artificial Sequence
  Description of Artificial Sequence: Synthetic polypeptide
DEAEIRTTNPVATCHYGQCVCSNWGEHNAEYFTSDNQS

SEQ ID NO: 203452 - protein, 38 aa, Artificial Sequence
  Description of Artificial Sequence: Synthetic polypeptide
DEEAISTTNPVATEGYGCVCSNWEEDHNQEYFNSDNQS

SEQ ID NO: 203453 - protein, 38 aa, Artificial Sequence
  Description of Artificial Sequence: Synthetic polypeptide
DEEAISTTNPVATEGYGCVCSNWGEDHNAENFNSDTQA

SEQ ID NO: 203454 - protein, 37 aa, Artificial Sequence
  Description of Artificial Sequence: Synthetic polypeptide
AENEIACTNPVATEQYGCSCSNWGEDNQEYFLSDNQS

SEQ ID NO: 203455 - protein, 39 aa, Artificial Sequence
  Description of Artificial Sequence: Synthetic polypeptide
DEEAISTTNPVATEQYGQCVCGTWGEGHNAENFNSDNQA

SEQ ID NO: 203456 - protein, 37 aa, Artificial Sequence
  Description of Artificial Sequence: Synthetic polypeptide
AENEIACTNPVATEQYGCSCSNWGEHNQEYFGSDTQS

SEQ ID NO: 203457 - protein, 37 aa, Artificial Sequence
  Description of Artificial Sequence: Synthetic polypeptide
SAEEIATTNPVATEQWGSVSVADPPGAEAHGIDLAVM

SEQ ID NO: 203458 - protein, 38 aa, Artificial Sequence
  Description of Artificial Sequence: Synthetic polypeptide
DEACISTTNPVATEQYGQCVCGNSGEHNAENFNSDNQS

SEQ ID NO: 203459 - protein, 38 aa, Artificial Sequence
  Description of Artificial Sequence: Synthetic polypeptide
DEMCISTTNPVATEQYGQCVCSNWGEDNAEFFNSDTQS

SEQ ID NO: 203460 - protein, 38 aa, Artificial Sequence
  Description of Artificial Sequence: Synthetic polypeptide
DEEAISTTNPVATEGYGCVCSNWGEDHNAENFNSDTQG

SEQ ID NO: 203461 - protein, 40 aa, Artificial Sequence
  Description of Artificial Sequence: Synthetic polypeptide
DEEEIRTTNPVAYEAYGGINSVLWNCSQWDRQYSSQIDEN

SEQ ID NO: 203462 - protein, 37 aa, Artificial Sequence
  Description of Artificial Sequence: Synthetic polypeptide
CEECISTTNPVATEGYGCVCSWGEDHNQENFNSDPQP

SEQ ID NO: 203463 - protein, 38 aa, Artificial Sequence
  Description of Artificial Sequence: Synthetic polypeptide
DEMCISTTNPVATEQYGQCVCSNWGEHNAENFNSDNQS

SEQ ID NO: 203464 - protein, 39 aa, Artificial Sequence
  Description of Artificial Sequence: Synthetic polypeptide
DEAEISTTNPVATEQYGQCVCSNWGEDHNAEHFNSDTQS

SEQ ID NO: 203465 - protein, 36 aa, Artificial Sequence
  Description of Artificial Sequence: Synthetic polypeptide
QEDEIATTNPVATEQWGGCNCAGTGQLDNIMGGELH

SEQ ID NO: 203466 - protein, 38 aa, Artificial Sequence
  Description of Artificial Sequence: Synthetic polypeptide
CEEEISTTNPVAYEGYGQCVCSNWGEHNAENFGSDNQE

SEQ ID NO: 203467 - protein, 38 aa, Artificial Sequence
  Description of Artificial Sequence: Synthetic polypeptide
DEACISTTNPVATEQYGQCVCSNWEEHNAENFNSDTQS

SEQ ID NO: 203468 - protein, 37 aa, Artificial Sequence
  Description of Artificial Sequence: Synthetic polypeptide
CETEIACTNPVATEQYGSACAAVATGVNTAGMDTEAS

SEQ ID NO: 203469 - protein, 39 aa, Artificial Sequence
  Description of Artificial Sequence: Synthetic polypeptide
DEEAISTTNPVATEGYGQCVCSNWGEDHNAENFGSENQS

SEQ ID NO: 203470 - protein, 39 aa, Artificial Sequence
  Description of Artificial Sequence: Synthetic polypeptide
DEACISTTNPVATEQYGQCVCSNWGEDHNAENFGSDNQS

SEQ ID NO: 203471 - protein, 34 aa, Artificial Sequence
  Description of Artificial Sequence: Synthetic polypeptide
DESEIRSTNPCSTEPWGCIAPEDQQQQQQQGTND

SEQ ID NO: 203472 - protein, 38 aa, Artificial Sequence
  Description of Artificial Sequence: Synthetic polypeptide
DEEEISTVNPVATEGYGQCVCSWGEDDNAENFNSQTQS

SEQ ID NO: 203473 - protein, 38 aa, Artificial Sequence
  Description of Artificial Sequence: Synthetic polypeptide
DEEEISTVNPVATEGYGCVCSNWMEDHNAENFNSQTQS

SEQ ID NO: 203474 - protein, 38 aa, Artificial Sequence
  Description of Artificial Sequence: Synthetic polypeptide
DDAEISTTNPVATEQYGQCVCSNSGEHNAEGFGSETQS

SEQ ID NO: 203475 - protein, 38 aa, Artificial Sequence
  Description of Artificial Sequence: Synthetic polypeptide
QEVEIGTTNPVATEQYGVVTVTGTDGGDEEEEGGNNDI

SEQ ID NO: 203476 - protein, 35 aa, Artificial Sequence
  Description of Artificial Sequence: Synthetic polypeptide
DSSEVASTNPVSYEGYGFVVACNTISQSQTGGQNR

SEQ ID NO: 203477 - protein, 38 aa, Artificial Sequence
  Description of Artificial Sequence: Synthetic polypeptide
DEAEISTTNPVATEQYGCVCSNSGEDHNQENFPSDTQP

SEQ ID NO: 203478 - protein, 37 aa, Artificial Sequence
  Description of Artificial Sequence: Synthetic polypeptide
QEVEIGTTNPVATEQYGVVVDGQDGGDEEEEDGNNDI

SEQ ID NO: 203479 - protein, 36 aa, Artificial Sequence
  Description of Artificial Sequence: Synthetic polypeptide
DSSEVASTNPVSYEGYGCNVVAANTISQSRTGGQNR

SEQ ID NO: 203480 - protein, 33 aa, Artificial Sequence
  Description of Artificial Sequence: Synthetic polypeptide
DESEIATTNPIGTEGWGVMWAAETWAEPKGDYI

SEQ ID NO: 203481 - protein, 39 aa, Artificial Sequence
  Description of Artificial Sequence: Synthetic polypeptide
CEEEISCTNPVATEQYGQCVCSTWGEDDNAENFNSDNQS

SEQ ID NO: 203482 - protein, 37 aa, Artificial Sequence
  Description of Artificial Sequence: Synthetic polypeptide
DEMEISTTNPVAYEQYGQCVCQWGAHNIENFNSDTQS

SEQ ID NO: 203483 - protein, 36 aa, Artificial Sequence
  Description of Artificial Sequence: Synthetic polypeptide
SDECIACTNPVATEQWGKVCSTWEDHQQHQHVGHVH

SEQ ID NO: 203484 - protein, 35 aa, Artificial Sequence
  Description of Artificial Sequence: Synthetic polypeptide
DSSEVASTNPVSTEPYGNVACNTEISQSVTGGQTR

SEQ ID NO: 203485 - protein, 39 aa, Artificial Sequence
  Description of Artificial Sequence: Synthetic polypeptide
DEMEISTTNPVATEQYGICVCSNWGEPPNAEFFNSDTQA

SEQ ID NO: 203486 - protein, 37 aa, Artificial Sequence
  Description of Artificial Sequence: Synthetic polypeptide
SDAEIRTTNPVATCQYGCVCSNWGEHNQEYFNSDTQA

SEQ ID NO: 203487 - protein, 39 aa, Artificial Sequence
  Description of Artificial Sequence: Synthetic polypeptide
QEVEIGTTNPVATEQYGVVVVSGTDGGDEETEEGGNNDI

SEQ ID NO: 203488 - protein, 34 aa, Artificial Sequence
  Description of Artificial Sequence: Synthetic polypeptide
DESEIATTNPIGTEGWGATTWANATLAEPKGPYI

SEQ ID NO: 203489 - protein, 39 aa, Artificial Sequence
  Description of Artificial Sequence: Synthetic polypeptide
DEEEISTTNPVAYEQYGCVVCSNWGEDHNQENFNSDTQS

SEQ ID NO: 203490 - protein, 39 aa, Artificial Sequence
  Description of Artificial Sequence: Synthetic polypeptide
DDEEISTTNPVATEQYGQCVCSNWGPDHNQENFNSDTQL

SEQ ID NO: 203491 - protein, 38 aa, Artificial Sequence
  Description of Artificial Sequence: Synthetic polypeptide
DEMCISTTNPVATEQYGCVCSNWGEDHNDENFNSDTQA

SEQ ID NO: 203492 - protein, 39 aa, Artificial Sequence
  Description of Artificial Sequence: Synthetic polypeptide
DEEEISTTNPVAYEQYGQCICSNSGEDHNAEHFNSDTQS

SEQ ID NO: 203493 - protein, 39 aa, Artificial Sequence
  Description of Artificial Sequence: Synthetic polypeptide
DEMEISTTNPVATEQYGICVCSNWGEDDNAENFGSDTQA

SEQ ID NO: 203494 - protein, 39 aa, Artificial Sequence
  Description of Artificial Sequence: Synthetic polypeptide
DDEEISTTNPVATEQYGQCVCSNWMEDDNAENFNSDNQS

SEQ ID NO: 203495 - protein, 38 aa, Artificial Sequence
  Description of Artificial Sequence: Synthetic polypeptide
QEVEIGTTNPVATEQYGTVVVTTDGGDEEEETGGNNDI

SEQ ID NO: 203496 - protein, 38 aa, Artificial Sequence
  Description of Artificial Sequence: Synthetic polypeptide
QEVEIGTTNPVATEQYGTVVVQTDGGDEEEEEGGLNDI

SEQ ID NO: 203497 - protein, 39 aa, Artificial Sequence
  Description of Artificial Sequence: Synthetic polypeptide
DEECISTTNPVATEQYGQCVCSNWGEDDNAENFNSDNQA

SEQ ID NO: 203498 - protein, 39 aa, Artificial Sequence
  Description of Artificial Sequence: Synthetic polypeptide
DEECISTTNPVATEQYGQCVCSNWGEAHNQENFNSETQG

SEQ ID NO: 203499 - protein, 39 aa, Artificial Sequence
  Description of Artificial Sequence: Synthetic polypeptide
DEECISTTNPVATEQYGQCVCSNWGEAHNAENFNSETQS

SEQ ID NO: 203500 - protein, 37 aa, Artificial Sequence
  Description of Artificial Sequence: Synthetic polypeptide
SDECIATTNPVATEQWGKVCSTWEDHQQHQHMVRHVS

SEQ ID NO: 203501 - protein, 39 aa, Artificial Sequence
  Description of Artificial Sequence: Synthetic polypeptide
DEECISTTNPVATEQYGQCVCSNWEEDHNAENFNSDPQG

SEQ ID NO: 203502 - protein, 39 aa, Artificial Sequence
  Description of Artificial Sequence: Synthetic polypeptide
DEECISTTNPVATEQYGQCVCSNWEEDHNAENFISDNQA

SEQ ID NO: 203503 - protein, 40 aa, Artificial Sequence
  Description of Artificial Sequence: Synthetic polypeptide
DNEEEHIADLSINQAVASTISQYYGSWVSTHLQNRYAFRV

SEQ ID NO: 203504 - protein, 38 aa, Artificial Sequence
  Description of Artificial Sequence: Synthetic polypeptide
AEEEISTTNPVATEQYGQCVCSNWGEHNAENFISDTQS

SEQ ID NO: 203505 - protein, 38 aa, Artificial Sequence
  Description of Artificial Sequence: Synthetic polypeptide
QEVEIGTTNPVATEQYGTVVVQTDGGDEEEEEGGNNNV

SEQ ID NO: 203506 - protein, 37 aa, Artificial Sequence
  Description of Artificial Sequence: Synthetic polypeptide
SDECIATTNPVATEQWGGVCSTWEDHQQHQHVTNHVS

SEQ ID NO: 203507 - protein, 39 aa, Artificial Sequence
  Description of Artificial Sequence: Synthetic polypeptide
QEVEIGTTNPVATEQYGQVTVVSGTDGGDEEEEGGNNDI

SEQ ID NO: 203508 - protein, 38 aa, Artificial Sequence
  Description of Artificial Sequence: Synthetic polypeptide
QEVEIGTTNPVATEQYGQVVVGGTDGGDEEEEGGNNDD

SEQ ID NO: 203509 - protein, 37 aa, Artificial Sequence
  Description of Artificial Sequence: Synthetic polypeptide
QEVEIGTTNPVATEQYGTVVDPGDGGDEEEEGGNFDI

SEQ ID NO: 203510 - protein, 38 aa, Artificial Sequence
  Description of Artificial Sequence: Synthetic polypeptide
CEEEISCTNPVATEQYGCVCSNWGEDHNAENFNSDTQA

SEQ ID NO: 203511 - protein, 38 aa, Artificial Sequence
  Description of Artificial Sequence: Synthetic polypeptide
QEVEIGTTNPVATEQYGTVVVATDGGDEEEEEGENNDI

SEQ ID NO: 203512 - protein, 38 aa, Artificial Sequence
  Description of Artificial Sequence: Synthetic polypeptide
QEVEIGTTNPVATEQYGTVVVATDGGDEEEEEGGNNGP

SEQ ID NO: 203513 - protein, 38 aa, Artificial Sequence
  Description of Artificial Sequence: Synthetic polypeptide
QEVEIGTTNPVATEQYGTVVVLDTDGGDEEEEGGNNDI

SEQ ID NO: 203514 - protein, 38 aa, Artificial Sequence
  Description of Artificial Sequence: Synthetic polypeptide
QEVEIGTTNPVATEQYGTVVVNTDGGDEEEEEGGNLDI

SEQ ID NO: 203515 - protein, 38 aa, Artificial Sequence
  Description of Artificial Sequence: Synthetic polypeptide
DDEEISTTNPVATEQYGQCVCSNWGEHNAENFISDTQS

SEQ ID NO: 203516 - protein, 39 aa, Artificial Sequence
  Description of Artificial Sequence: Synthetic polypeptide
DDEEISTTNPVATEQYGQCVCSNWMEDHNAENFGSETQA

SEQ ID NO: 203517 - protein, 34 aa, Artificial Sequence
  Description of Artificial Sequence: Synthetic polypeptide
DESEIATTNPIGTECWGATTWANATLAEPKGPYI

SEQ ID NO: 203518 - protein, 39 aa, Artificial Sequence
  Description of Artificial Sequence: Synthetic polypeptide
DEEEISTTNPVAYEQYGQCQVCSNSGEHNEEYFNSDTQL

SEQ ID NO: 203519 - protein, 39 aa, Artificial Sequence
  Description of Artificial Sequence: Synthetic polypeptide
DEEEISTTNPVAYEQYGQCVCQNSGEDHNAENFNSDTQA

SEQ ID NO: 203520 - protein, 37 aa, Artificial Sequence
  Description of Artificial Sequence: Synthetic polypeptide
DEMAISTTNPVAYEQYGQCFCSWGEHNIENFGSDNQS

SEQ ID NO: 203521 - protein, 38 aa, Artificial Sequence
  Description of Artificial Sequence: Synthetic polypeptide
DEMEISTTNPVATEQYGQCTCSNWGEHNAEYFNSDTQS

SEQ ID NO: 203522 - protein, 39 aa, Artificial Sequence
  Description of Artificial Sequence: Synthetic polypeptide
DEAEISTTNPVATEQYGQCVCSNWGEDHNAENFNSDNQA

SEQ ID NO: 203523 - protein, 37 aa, Artificial Sequence
  Description of Artificial Sequence: Synthetic polypeptide
CEEEIACTNPVATEQWGCCNAGNNGDHQTAGNDIGDS

SEQ ID NO: 203524 - protein, 38 aa, Artificial Sequence
  Description of Artificial Sequence: Synthetic polypeptide
DDEEISTTNPVAYCQYGQCVCSNWGEPNAEYFGSDNQS

SEQ ID NO: 203525 - protein, 39 aa, Artificial Sequence
  Description of Artificial Sequence: Synthetic polypeptide
DEEEISTTNPVAYEQYGQCVCQNWGEDHNQEYFGSETQS

SEQ ID NO: 203526 - protein, 39 aa, Artificial Sequence
  Description of Artificial Sequence: Synthetic polypeptide
DEMEISTTNPVATEQYGQCVCGNSGEDHNAENFNSDTQA

SEQ ID NO: 203527 - protein, 39 aa, Artificial Sequence
  Description of Artificial Sequence: Synthetic polypeptide
DEEEISTTNPVAYEQYGQCVCPNWGEDHEQENFGSDTQN

SEQ ID NO: 203528 - protein, 38 aa, Artificial Sequence
  Description of Artificial Sequence: Synthetic polypeptide
DEEEISTTNPVAYEQYGQCVCQNWGEDNAEYFDSDTQS

SEQ ID NO: 203529 - protein, 38 aa, Artificial Sequence
  Description of Artificial Sequence: Synthetic polypeptide
DEEEISTTNPVAYEQYGQCVCQNWGEHNQEYFDSDTQA

SEQ ID NO: 203530 - protein, 39 aa, Artificial Sequence
  Description of Artificial Sequence: Synthetic polypeptide
SEEEIRTTNPVATEGYGQCVTSTWGADHNAEHFISDPQS

SEQ ID NO: 203531 - protein, 39 aa, Artificial Sequence
  Description of Artificial Sequence: Synthetic polypeptide
SEEEIRTTNPVATEGYGQCVCSNWGEDHNAENFGSDTQS

SEQ ID NO: 203532 - protein, 39 aa, Artificial Sequence
  Description of Artificial Sequence: Synthetic polypeptide
DEECISTTNPVATEQYGQCVCSNSGEAHNAENFNSDTQA

SEQ ID NO: 203533 - protein, 36 aa, Artificial Sequence
  Description of Artificial Sequence: Synthetic polypeptide
CEEEIACTNPVATEQWACCCATNGQNPETLENGEEA

SEQ ID NO: 203534 - protein, 37 aa, Artificial Sequence
  Description of Artificial Sequence: Synthetic polypeptide
DEEEIRTTNPVCYEHYGCVCSNWGEHNQENFISDTQS

SEQ ID NO: 203535 - protein, 38 aa, Artificial Sequence
  Description of Artificial Sequence: Synthetic polypeptide
DEEEIRTTNPVCYEGYGQCVCSNWGEHNAENFGSDTQS

SEQ ID NO: 203536 - protein, 39 aa, Artificial Sequence
  Description of Artificial Sequence: Synthetic polypeptide
DEECISTTNPVATEQYGQCVCSDWGEDDNAENFSSDNQA

SEQ ID NO: 203537 - protein, 38 aa, Artificial Sequence
  Description of Artificial Sequence: Synthetic polypeptide
DEEEISTTNPVAYEQYGQCVCQNWGEHNAENFNSDTQS

SEQ ID NO: 203538 - protein, 38 aa, Artificial Sequence
  Description of Artificial Sequence: Synthetic polypeptide
DEEEISTTNPVAYEQYGQCVCGWGEDDNAENFGSETQA

SEQ ID NO: 203539 - protein, 39 aa, Artificial Sequence
  Description of Artificial Sequence: Synthetic polypeptide
DEEEISTTNPVAYEQYGQCVCGTWGEDHNAEYFNSENQA

SEQ ID NO: 203540 - protein, 37 aa, Artificial Sequence
  Description of Artificial Sequence: Synthetic polypeptide
DEAEIACTNPVATEQWGCNVAGANGGLAEPPGEDTDM

SEQ ID NO: 203541 - protein, 34 aa, Artificial Sequence
  Description of Artificial Sequence: Synthetic polypeptide
DESEIATTNPIGTECWGATTWANADLAEPKGPYI

SEQ ID NO: 203542 - protein, 35 aa, Artificial Sequence
  Description of Artificial Sequence: Synthetic polypeptide
DSSEVACTNPVSTEGYGNVCYNTIDQSRHGMQGHM

SEQ ID NO: 203543 - protein, 35 aa, Artificial Sequence
  Description of Artificial Sequence: Synthetic polypeptide
DESEIRTTNPCSTEPWGCIAPEDQQQQQQQAGTNP

SEQ ID NO: 203544 - protein, 35 aa, Artificial Sequence
  Description of Artificial Sequence: Synthetic polypeptide
DSSEMASTNPVSYEGYGNVVACNTISASQVGGQNR

SEQ ID NO: 203545 - protein, 39 aa, Artificial Sequence
  Description of Artificial Sequence: Synthetic polypeptide
DEEEISTTNPVAYEQYGQCQVCSNWGEHNAESFNSDNQA

SEQ ID NO: 203546 - protein, 39 aa, Artificial Sequence
  Description of Artificial Sequence: Synthetic polypeptide
DEEEISTTNPVAYEQYGQCQVCSSGEDHNAENFNSDTQA

SEQ ID NO: 203547 - protein, 40 aa, Artificial Sequence
  Description of Artificial Sequence: Synthetic polypeptide
DEEEISTTNPVAYEQYGQCQVCSTWGEDDNAENFNSETQA

SEQ ID NO: 203548 - protein, 40 aa, Artificial Sequence
  Description of Artificial Sequence: Synthetic polypeptide
DEEEISTTNPVAYEQYGQCQVCSTWGEDHNTENFNSDTQS

SEQ ID NO: 203549 - protein, 39 aa, Artificial Sequence
  Description of Artificial Sequence: Synthetic polypeptide
DEEEISTTNPVAYEQYGQCSCSMWEEDDNAEYINSDTQA

SEQ ID NO: 203550 - protein, 34 aa, Artificial Sequence
  Description of Artificial Sequence: Synthetic polypeptide
DESEIATTNPIATECWGVMWANAETWAEPKGDYI

SEQ ID NO: 203551 - protein, 36 aa, Artificial Sequence
  Description of Artificial Sequence: Synthetic polypeptide
DSSEIRTTNPVAYKAWGISTVPNANSSSDREGGMVM

SEQ ID NO: 203552 - protein, 38 aa, Artificial Sequence
  Description of Artificial Sequence: Synthetic polypeptide
DDEEISTTNPVATEQYGQCVCSWGEDHNAENFISDTQL

SEQ ID NO: 203553 - protein, 39 aa, Artificial Sequence
  Description of Artificial Sequence: Synthetic polypeptide
DEEEISTTNPVAYEQYGQCVCENWGEDHNAEGFNSDTQA

SEQ ID NO: 203554 - protein, 38 aa, Artificial Sequence
  Description of Artificial Sequence: Synthetic polypeptide
DEMCISTTNPVATEQYGCVCSNWGELPNAEFFGSDTQA

SEQ ID NO: 203555 - protein, 39 aa, Artificial Sequence
  Description of Artificial Sequence: Synthetic polypeptide
DEEEISTTNPVAYEQYGQCVCGNWGEDHNAEGFNSDTQA

SEQ ID NO: 203556 - protein, 38 aa, Artificial Sequence
  Description of Artificial Sequence: Synthetic polypeptide
DEMEISTTNPVATEQYGQCTCSMWEEDNAEYFNSDTQA

SEQ ID NO: 203557 - protein, 38 aa, Artificial Sequence
  Description of Artificial Sequence: Synthetic polypeptide
DDEEISTTNPVATEYYGQCVCSNWEEHNAEHFNSDTQS

SEQ ID NO: 203558 - protein, 37 aa, Artificial Sequence
  Description of Artificial Sequence: Synthetic polypeptide
DEMCISTTNPVATEQYGCVCSNWGEPNAENFSSDTQA

SEQ ID NO: 203559 - protein, 38 aa, Artificial Sequence
  Description of Artificial Sequence: Synthetic polypeptide
DEEEISTTNPVAYEQYGQCVCGNWGEHNAENFNSDTQS

SEQ ID NO: 203560 - protein, 39 aa, Artificial Sequence
  Description of Artificial Sequence: Synthetic polypeptide
DDEEISTTNPVATEQYGQCVCSNWGEEHNAESFNSDTQA

SEQ ID NO: 203561 - protein, 39 aa, Artificial Sequence
  Description of Artificial Sequence: Synthetic polypeptide
DEECISTTNPVATEQYGQCVCSNWGEDDNAENFNSDNQS

SEQ ID NO: 203562 - protein, 39 aa, Artificial Sequence
  Description of Artificial Sequence: Synthetic polypeptide
DEDEIRTTNPVAYEQWGVACYTNDELHHDSQNTQGQDDD

SEQ ID NO: 203563 - protein, 39 aa, Artificial Sequence
  Description of Artificial Sequence: Synthetic polypeptide
DEDEIRTTNPVAYEQWGVACYTGDVLHNDQNTQGQDDTS

SEQ ID NO: 203564 - protein, 39 aa, Artificial Sequence
  Description of Artificial Sequence: Synthetic polypeptide
DDEEISTTNPVATEQYGQCVCSNWGEDHNAEFFGSDTQS

SEQ ID NO: 203565 - protein, 39 aa, Artificial Sequence
  Description of Artificial Sequence: Synthetic polypeptide
CEEEIRTTNPVAYEQYGQCVCSNWGEDHNQENFGSDTQA

SEQ ID NO: 203566 - protein, 39 aa, Artificial Sequence
  Description of Artificial Sequence: Synthetic polypeptide
SEEEIRTTNPVATEQYGQCVCGNWGADHNAENFSSDTQS

SEQ ID NO: 203567 - protein, 39 aa, Artificial Sequence
  Description of Artificial Sequence: Synthetic polypeptide
ADEEISTTNPVATEQYGQCVCSTWGEDHNAENFNSDTQA

SEQ ID NO: 203568 - protein, 39 aa, Artificial Sequence
  Description of Artificial Sequence: Synthetic polypeptide
DDEEISTTNPVATEQYGQCVCSNWGEDHNAEGFGSDTQA

SEQ ID NO: 203569 - protein, 35 aa, Artificial Sequence
  Description of Artificial Sequence: Synthetic polypeptide
DSSEVASTNPVSYEGYGNVVACNTISTSLVGGQNN

SEQ ID NO: 203570 - protein, 39 aa, Artificial Sequence
  Description of Artificial Sequence: Synthetic polypeptide
DDEEISTTNPVATEQYGQCVCSNWGEDHNAENFGSDTQA

SEQ ID NO: 203571 - protein, 37 aa, Artificial Sequence
  Description of Artificial Sequence: Synthetic polypeptide
SDECIATTNPVATEQWGKVCSTWEDHQQHQHVMKGVH

SEQ ID NO: 203572 - protein, 38 aa, Artificial Sequence
  Description of Artificial Sequence: Synthetic polypeptide
DEEEISTTNPVAYEQYGCVCSNWGEDDNQENFISDTQA

SEQ ID NO: 203573 - protein, 35 aa, Artificial Sequence
  Description of Artificial Sequence: Synthetic polypeptide
DESEIRTTNPIATECWGATGCANAEDWDEPKGPYP

SEQ ID NO: 203574 - protein, 39 aa, Artificial Sequence
  Description of Artificial Sequence: Synthetic polypeptide
DDEEISTTNPVATEQYGQCVCSNWGEDHNAENFLSDNQA

SEQ ID NO: 203575 - protein, 38 aa, Artificial Sequence
  Description of Artificial Sequence: Synthetic polypeptide
DEEEISTTNPVAYEQYGCVCSNWGEDHNAENFISDTQS

SEQ ID NO: 203576 - protein, 38 aa, Artificial Sequence
  Description of Artificial Sequence: Synthetic polypeptide
DEEEISTTNPVAYEQYGCVCSNWGEDHNAENFISETQS

SEQ ID NO: 203577 - protein, 39 aa, Artificial Sequence
  Description of Artificial Sequence: Synthetic polypeptide
DDEEISTTNPVATEQYGQCVCSNWGEDHNAENFNSDTQD

SEQ ID NO: 203578 - protein, 39 aa, Artificial Sequence
  Description of Artificial Sequence: Synthetic polypeptide
DDEEISTTNPVATEQYGQCVCSNWGEDHNAENFNSDTQS

SEQ ID NO: 203579 - protein, 39 aa, Artificial Sequence
  Description of Artificial Sequence: Synthetic polypeptide
DDEEISTTNPVATEQYGQCVCSNWGEDHNAENFNSENQS

SEQ ID NO: 203580 - protein, 34 aa, Artificial Sequence
  Description of Artificial Sequence: Synthetic polypeptide
QETEIRTTNPIATECWGVTWANAEDWAEHKGDYI

SEQ ID NO: 203581 - protein, 38 aa, Artificial Sequence
  Description of Artificial Sequence: Synthetic polypeptide
DEEEISTTNPVAYEQYGCVCSNWGEDHNQENFFSETQS

SEQ ID NO: 203582 - protein, 35 aa, Artificial Sequence
  Description of Artificial Sequence: Synthetic polypeptide
DESEIRTTNPIATECWGATDWANAEDWAEPKGPYI

SEQ ID NO: 203583 - protein, 39 aa, Artificial Sequence
  Description of Artificial Sequence: Synthetic polypeptide
DDEEISTTNPVATEQYGQCVCSNWGEDDNTENFISDFQS

SEQ ID NO: 203584 - protein, 39 aa, Artificial Sequence
  Description of Artificial Sequence: Synthetic polypeptide
CEEEIRTTNPVAYEQYGQCVCSNWGEDDNAENFNSDTQS

SEQ ID NO: 203585 - protein, 39 aa, Artificial Sequence
  Description of Artificial Sequence: Synthetic polypeptide
CEEEIRTTNPVAYEQYGQCVCSNWGEDDNAENFNSDNQD

SEQ ID NO: 203586 - protein, 38 aa, Artificial Sequence
  Description of Artificial Sequence: Synthetic polypeptide
DDAEISTTNPVATEGYGCVTSTWGADHNAENFGSDPQA

SEQ ID NO: 203587 - protein, 38 aa, Artificial Sequence
  Description of Artificial Sequence: Synthetic polypeptide
AEEEISTTNPVATEQYGCVCSNWGEDHNAENFISDFQS

SEQ ID NO: 203588 - protein, 39 aa, Artificial Sequence
  Description of Artificial Sequence: Synthetic polypeptide
DEMEISTTNPVATEQYGCAVCSNWGEDHNAENFNSDNQS

SEQ ID NO: 203589 - protein, 39 aa, Artificial Sequence
  Description of Artificial Sequence: Synthetic polypeptide
DEMEISTTNPVATEQYGCQVCSNWGEDPNAEFFGSDTQA

SEQ ID NO: 203590 - protein, 39 aa, Artificial Sequence
  Description of Artificial Sequence: Synthetic polypeptide
DDEEISTTNPVATEQYGQCVCSNWGEDDNAENFNSDFQS

SEQ ID NO: 203591 - protein, 39 aa, Artificial Sequence
  Description of Artificial Sequence: Synthetic polypeptide
DEECISTTNPVATEQYGQCVCSNWGEDHNAENFNSETQS

SEQ ID NO: 203592 - protein, 39 aa, Artificial Sequence
  Description of Artificial Sequence: Synthetic polypeptide
DEECISTTNPVATEQYGQCVCSNWGEDHNAENFNSDTQS

SEQ ID NO: 203593 - protein, 38 aa, Artificial Sequence
  Description of Artificial Sequence: Synthetic polypeptide
CEEEIRTTNPVAYEGYGCVCSNWGEDHNQENFNSDFQA

SEQ ID NO: 203594 - protein, 39 aa, Artificial Sequence
  Description of Artificial Sequence: Synthetic polypeptide
DEECISTTNPVATEQYGQCVCSNWGEDHNAENFNSDTQF

SEQ ID NO: 203595 - protein, 38 aa, Artificial Sequence
  Description of Artificial Sequence: Synthetic polypeptide
DEMEISTTNPVATEQYGCSCSNWPEDDNAENFDSDTQS

SEQ ID NO: 203596 - protein, 39 aa, Artificial Sequence
  Description of Artificial Sequence: Synthetic polypeptide
DEECISTTNPVATEQYGQCVCSNWGEDHNAENFNSDTQA

SEQ ID NO: 203597 - protein, 38 aa, Artificial Sequence
  Description of Artificial Sequence: Synthetic polypeptide
DEMEISTTNPVATEQYGCVCQNWGADHNIENFSSDTQS

SEQ ID NO: 203598 - protein, 39 aa, Artificial Sequence
  Description of Artificial Sequence: Synthetic polypeptide
DDEEISTTNPVATEQYGQCVCSNWGEDDNAENFNSDTQA

SEQ ID NO: 203599 - protein, 35 aa, Artificial Sequence
  Description of Artificial Sequence: Synthetic polypeptide
DEDEIATTNPVAYEPWGSTPAAANGEGTGTGGSEH

SEQ ID NO: 203600 - protein, 35 aa, Artificial Sequence
  Description of Artificial Sequence: Synthetic polypeptide
DSSEVASTNPVSYEGYGNVVACVTISQSTVGGQNR

SEQ ID NO: 203601 - protein, 39 aa, Artificial Sequence
  Description of Artificial Sequence: Synthetic polypeptide
DEECISTTNPVATEQYGQCVCSNWGEDHNAENFNSDPQS

SEQ ID NO: 203602 - protein, 39 aa, Artificial Sequence
  Description of Artificial Sequence: Synthetic polypeptide
DEECISTTNPVATEQYGQCVCSNWGEDHNAENFNSDNQA

SEQ ID NO: 203603 - protein, 39 aa, Artificial Sequence
  Description of Artificial Sequence: Synthetic polypeptide
DDEEISTTNPVATEQYGQCVCSNWGEDDNAEYFNSENQS

SEQ ID NO: 203604 - protein, 39 aa, Artificial Sequence
  Description of Artificial Sequence: Synthetic polypeptide
DDEEISTTNPVATEQYGQCVCSNWGEDDNIENFISDNQP

SEQ ID NO: 203605 - protein, 38 aa, Artificial Sequence
  Description of Artificial Sequence: Synthetic polypeptide
DEEEISTTNPVAYEQYGCVCSNWGEDHNQENFISDPQS

SEQ ID NO: 203606 - protein, 39 aa, Artificial Sequence
  Description of Artificial Sequence: Synthetic polypeptide
DEAEISTTNPVATEQYGQCVCSNWGEDHNAENFNSDFQL

SEQ ID NO: 203607 - protein, 38 aa, Artificial Sequence
  Description of Artificial Sequence: Synthetic polypeptide
DEEEISTTNPVAYEQYGCVCSNWGEDHNQENFISDTQA

SEQ ID NO: 203608 - protein, 38 aa, Artificial Sequence
  Description of Artificial Sequence: Synthetic polypeptide
DEEEISTTNPVAYEQYGCVCSNWGEDHNQENFISETQA

SEQ ID NO: 203609 - protein, 33 aa, Artificial Sequence
  Description of Artificial Sequence: Synthetic polypeptide
QEVEIACTNPCSYEQWGITCYCNDQQDHGDTRS

SEQ ID NO: 203610 - protein, 39 aa, Artificial Sequence
  Description of Artificial Sequence: Synthetic polypeptide
DEDEIRTTNPVAYEQWGVACYTGDNLHNDQQMTQGQGDD

SEQ ID NO: 203611 - protein, 40 aa, Artificial Sequence
  Description of Artificial Sequence: Synthetic polypeptide
DEEEIRTTNPVATEQYGDTYAISPTATSVHVVSPFQNETN

SEQ ID NO: 203612 - protein, 39 aa, Artificial Sequence
  Description of Artificial Sequence: Synthetic polypeptide
DDEEISTTNPVATEQYGQCVCSNWGEDHNQEHFGSDTQA

SEQ ID NO: 203613 - protein, 38 aa, Artificial Sequence
  Description of Artificial Sequence: Synthetic polypeptide
DEDEIRTTNPVAYEQWGVACYTGDNLHNDTNGQGQDDD

SEQ ID NO: 203614 - protein, 39 aa, Artificial Sequence
  Description of Artificial Sequence: Synthetic polypeptide
DDEEISTTNPVATEQYGQCVCSNWGEDHNQEYFNSETQA

SEQ ID NO: 203615 - protein, 39 aa, Artificial Sequence
  Description of Artificial Sequence: Synthetic polypeptide
DEECISTTNPVATEQYGQCVCSNWGEDHNAEHFNSENQS

SEQ ID NO: 203616 - protein, 35 aa, Artificial Sequence
  Description of Artificial Sequence: Synthetic polypeptide
DSSEVASTNPVSYEGYGNVVACNDISQSQLGGQNR

SEQ ID NO: 203617 - protein, 37 aa, Artificial Sequence
  Description of Artificial Sequence: Synthetic polypeptide
SDECIATTNPVATEQWGKVCSTWEDHQQHQHVGDHVH

SEQ ID NO: 203618 - protein, 36 aa, Artificial Sequence
  Description of Artificial Sequence: Synthetic polypeptide
SDECIATTNPVATEQWGKVCSTWEDHQQHQHVAESN

SEQ ID NO: 203619 - protein, 37 aa, Artificial Sequence
  Description of Artificial Sequence: Synthetic polypeptide
QEVEIATTNCVATEQYGVVAGPGFTGEGGQGTGEEDT

SEQ ID NO: 203620 - protein, 39 aa, Artificial Sequence
  Description of Artificial Sequence: Synthetic polypeptide
DEECISTTNPVATEQYGQCVCSNWGEDHNAEHFNSDTQS

SEQ ID NO: 203621 - protein, 36 aa, Artificial Sequence
  Description of Artificial Sequence: Synthetic polypeptide
SDECIATTNPVATEQWGKVCSTWEDHQQHQHQAEPK

SEQ ID NO: 203622 - protein, 39 aa, Artificial Sequence
  Description of Artificial Sequence: Synthetic polypeptide
DEECISTTNPVATEQYGQCVCSNWGEDDNAENFNSDTQS

SEQ ID NO: 203623 - protein, 39 aa, Artificial Sequence
  Description of Artificial Sequence: Synthetic polypeptide
DEMEISTTNPVAYEQYGQCVCSMWGEDTNAENFNSENQA

SEQ ID NO: 203624 - protein, 38 aa, Artificial Sequence
  Description of Artificial Sequence: Synthetic polypeptide
DEMEISTTNPVAYEQYGQCVCSMWEEHNIESFNSDNQS

SEQ ID NO: 203625 - protein, 34 aa, Artificial Sequence
  Description of Artificial Sequence: Synthetic polypeptide
DSSEVASTNPVSYEGYGNVACNTEISQSRVGGSQ

SEQ ID NO: 203626 - protein, 39 aa, Artificial Sequence
  Description of Artificial Sequence: Synthetic polypeptide
DDEEISTTNPVATEQYGQCVCSNWGEEHNAENFNSDNQA

SEQ ID NO: 203627 - protein, 37 aa, Artificial Sequence
  Description of Artificial Sequence: Synthetic polypeptide
SDECIATTNPVATEQWGKVCSTWEDHQQHQHQPNGEK

SEQ ID NO: 203628 - protein, 38 aa, Artificial Sequence
  Description of Artificial Sequence: Synthetic polypeptide
DEDEIRTTNPVAYEQWGVACYTGDNLHNDQNTQSQDDK

SEQ ID NO: 203629 - protein, 39 aa, Artificial Sequence
  Description of Artificial Sequence: Synthetic polypeptide
DEDEIRTTNPVAYEQWGVACYTGDNLHNDQNTQGQMDDQ

SEQ ID NO: 203630 - protein, 37 aa, Artificial Sequence
  Description of Artificial Sequence: Synthetic polypeptide
DEFEIATTNPVAYNQYGCTIPNPNVLPQEASINEQTS

SEQ ID NO: 203631 - protein, 38 aa, Artificial Sequence
  Description of Artificial Sequence: Synthetic polypeptide
AEEEISTTNPVATEQYGCVCSNWGEDHNQENFSSETQS

SEQ ID NO: 203632 - protein, 39 aa, Artificial Sequence
  Description of Artificial Sequence: Synthetic polypeptide
DEECISTTNPVATEQYGQCVCSNWGEDHNAENFISDNQS

SEQ ID NO: 203633 - protein, 39 aa, Artificial Sequence
  Description of Artificial Sequence: Synthetic polypeptide
DDEEISTTNPVATEQYGQCVCSNWGEDHNAESSNSDNQA

SEQ ID NO: 203634 - protein, 39 aa, Artificial Sequence
  Description of Artificial Sequence: Synthetic polypeptide
DDEEISTTNPVATEQYGQCVCSNWGEDHNAEYFNSDTQA

SEQ ID NO: 203635 - protein, 35 aa, Artificial Sequence
  Description of Artificial Sequence: Synthetic polypeptide
DSSEVASTNPVSYEGYGNVVACNTISQLQVGGQNP

SEQ ID NO: 203636 - protein, 39 aa, Artificial Sequence
  Description of Artificial Sequence: Synthetic polypeptide
DDEEISTTNPVATEQYGQCVCSNWGEDHNAEYFNSDTQS

SEQ ID NO: 203637 - protein, 39 aa, Artificial Sequence
  Description of Artificial Sequence: Synthetic polypeptide
DDEEISTTNPVATEQYGQCVCSNWGEDHNAEYFNSETQQ

SEQ ID NO: 203638 - protein, 38 aa, Artificial Sequence
  Description of Artificial Sequence: Synthetic polypeptide
DEDEIRTTNPVAYEQWGVACYTGDELHNDQNTKGQDDP

SEQ ID NO: 203639 - protein, 38 aa, Artificial Sequence
  Description of Artificial Sequence: Synthetic polypeptide
DEDEIRTTNPVAYEQWGVACYTGDEQHNDQNTNGQDDD

SEQ ID NO: 203640 - protein, 38 aa, Artificial Sequence
  Description of Artificial Sequence: Synthetic polypeptide
DEDEIRTTNPVAYEQWGVACYTGDGLHNDQNIQGQDDD

SEQ ID NO: 203641 - protein, 39 aa, Artificial Sequence
  Description of Artificial Sequence: Synthetic polypeptide
DEDEIRTTNPVAYEQWGVACYTGDNLHNDERNTQGQDDD

SEQ ID NO: 203642 - protein, 39 aa, Artificial Sequence
  Description of Artificial Sequence: Synthetic polypeptide
DDEEISTTNPVATEQYGQCVCSNWGEDHNAEYFNSQTQS

SEQ ID NO: 203643 - protein, 35 aa, Artificial Sequence
  Description of Artificial Sequence: Synthetic polypeptide
DSSEVASTNPVSYEGYGNVVACNSISQSMVGGQNR

SEQ ID NO: 203644 - protein, 34 aa, Artificial Sequence
  Description of Artificial Sequence: Synthetic polypeptide
QETEIRTTNPVGTECWGVTWANAEDWAEHKGDYI

SEQ ID NO: 203645 - protein, 33 aa, Artificial Sequence
  Description of Artificial Sequence: Synthetic polypeptide
QETEIRTTNPVGTEGWGVTWAAEDWAEHKGDYI

SEQ ID NO: 203646 - protein, 38 aa, Artificial Sequence
  Description of Artificial Sequence: Synthetic polypeptide
DEDEIRTTNPVAYEQWGVACYTGDNLHNDHMTQGHQDD

SEQ ID NO: 203647 - protein, 38 aa, Artificial Sequence
  Description of Artificial Sequence: Synthetic polypeptide
QETEIVTTNPVATEQYGDVVVMNSDGNGEFEDGDIGED

SEQ ID NO: 203648 - protein, 38 aa, Artificial Sequence
  Description of Artificial Sequence: Synthetic polypeptide
DEDEIRTTNPVAYEQWGVACYTGDNLHNDQMTQDQADD

SEQ ID NO: 203649 - protein, 39 aa, Artificial Sequence
  Description of Artificial Sequence: Synthetic polypeptide
DEDEIRTTNPVAYEQWGVACYTGDNLHNDQMTQGQDHDA

SEQ ID NO: 203650 - protein, 32 aa, Artificial Sequence
  Description of Artificial Sequence: Synthetic polypeptide
QENEIASTNPCSYEQWGITCYCNDQQDTGDTS

SEQ ID NO: 203651 - protein, 36 aa, Artificial Sequence
  Description of Artificial Sequence: Synthetic polypeptide
SEAEIATTNPVATEQWGTNVCAAAGALTEHQDDDAQ

SEQ ID NO: 203652 - protein, 35 aa, Artificial Sequence
  Description of Artificial Sequence: Synthetic polypeptide
DSPEIATTNPVAYEPWGSVTQQNMHSMNASGIEYK

SEQ ID NO: 203653 - protein, 35 aa, Artificial Sequence
  Description of Artificial Sequence: Synthetic polypeptide
DSPEIATTNPVAYEHWGCVTQQNMHSMNASGNEAK

SEQ ID NO: 203654 - protein, 38 aa, Artificial Sequence
  Description of Artificial Sequence: Synthetic polypeptide
DEEEISTTNPVAYEQYGQCVCSNWGEHNAENFISDTQS

SEQ ID NO: 203655 - protein, 38 aa, Artificial Sequence
  Description of Artificial Sequence: Synthetic polypeptide
DEEEISTTNPVAYEQYGQCVCSNWGEHNAENFISETQA

SEQ ID NO: 203656 - protein, 37 aa, Artificial Sequence
  Description of Artificial Sequence: Synthetic polypeptide
DEDEIRTTNPVCYERYGCCCVVACTNAISHVGPGEQV

SEQ ID NO: 203657 - protein, 37 aa, Artificial Sequence
  Description of Artificial Sequence: Synthetic polypeptide
DEDEIRTTNPVGTEQWGCVAGPANEPGGETGGDIEAM

SEQ ID NO: 203658 - protein, 38 aa, Artificial Sequence
  Description of Artificial Sequence: Synthetic polypeptide
DDAEISTTNPVATEQYGCVCSNWGEDHNAENFNSDTQS

SEQ ID NO: 203659 - protein, 34 aa, Artificial Sequence
  Description of Artificial Sequence: Synthetic polypeptide
QECEICATNPCTTEIYGVVATQAGTTNQNGDTTD

SEQ ID NO: 203660 - protein, 38 aa, Artificial Sequence
  Description of Artificial Sequence: Synthetic polypeptide
DEMEISTTNPVAYEQYGCVCSNWGEGPNAENFNSDTQA

SEQ ID NO: 203661 - protein, 38 aa, Artificial Sequence
  Description of Artificial Sequence: Synthetic polypeptide
DEEEISTTNPVAYEQYGQCVCSNWGEHNIENFISDTQA

SEQ ID NO: 203662 - protein, 38 aa, Artificial Sequence
  Description of Artificial Sequence: Synthetic polypeptide
DEEEISTTNPVAYEQYGQCVCSNWGEHNAENFISDTQA

SEQ ID NO: 203663 - protein, 34 aa, Artificial Sequence
  Description of Artificial Sequence: Synthetic polypeptide
QECEICATNPCTTEIYGVVATQAGTTNQNGEDTT

SEQ ID NO: 203664 - protein, 39 aa, Artificial Sequence
  Description of Artificial Sequence: Synthetic polypeptide
DEEEISTTNPVAYEQYGQCVCSNWGELHNAENFNSETQG

SEQ ID NO: 203665 - protein, 39 aa, Artificial Sequence
  Description of Artificial Sequence: Synthetic polypeptide
DEEEISTTNPVAYEQYGQCVCSNWGNDDNQEYFISDTQS

SEQ ID NO: 203666 - protein, 39 aa, Artificial Sequence
  Description of Artificial Sequence: Synthetic polypeptide
DEEEISTTNPVAYEQYGQCVCSNWGYDHNQEHFNSDNQA

SEQ ID NO: 203667 - protein, 39 aa, Artificial Sequence
  Description of Artificial Sequence: Synthetic polypeptide
DEEEISTTNPVAYEQYGQCVCSNWMEDDNQEYFNSENQA

SEQ ID NO: 203668 - protein, 38 aa, Artificial Sequence
  Description of Artificial Sequence: Synthetic polypeptide
QEYEIRTTNPVATDQYGMITVNMGMEDINEEGGNEDDG

SEQ ID NO: 203669 - protein, 39 aa, Artificial Sequence
  Description of Artificial Sequence: Synthetic polypeptide
DEEEISTTNPVAYEQYGQCVCSNWMEDHNAENFNSDTQA

SEQ ID NO: 203670 - protein, 38 aa, Artificial Sequence
  Description of Artificial Sequence: Synthetic polypeptide
SAEEIATTNPVAYEQYGSVCSPANPALGIDHADDTKAK

SEQ ID NO: 203671 - protein, 39 aa, Artificial Sequence
  Description of Artificial Sequence: Synthetic polypeptide
DEEEISTTNPVAYEQYGQCVCSNWPEDHNAENFNSDTQS

SEQ ID NO: 203672 - protein, 36 aa, Artificial Sequence
  Description of Artificial Sequence: Synthetic polypeptide
CEEVIACTNPVATEQWGCVAGTEVLEAGPGGEEDAE

SEQ ID NO: 203673 - protein, 39 aa, Artificial Sequence
  Description of Artificial Sequence: Synthetic polypeptide
DEEEISTTNPVAYEQYGQCVCSNWVEDHNAENFNSDTQS

SEQ ID NO: 203674 - protein, 38 aa, Artificial Sequence
  Description of Artificial Sequence: Synthetic polypeptide
DEEEISTTNPVAYEQYGQCVCSNWGEHNAENFISDPQS

SEQ ID NO: 203675 - protein, 39 aa, Artificial Sequence
  Description of Artificial Sequence: Synthetic polypeptide
DEEEISTTNPVAYEQYGQCVCSNWGEEDNQENFNSDNQS

SEQ ID NO: 203676 - protein, 38 aa, Artificial Sequence
  Description of Artificial Sequence: Synthetic polypeptide
FEEEIRTTNPVAQKEDWYGGVNALTMYDQVQPQSVDNF

SEQ ID NO: 203677 - protein, 38 aa, Artificial Sequence
  Description of Artificial Sequence: Synthetic polypeptide
DEEQIATTNPVATASWGCSHVAGTNHGPLASGEGAMTN

SEQ ID NO: 203678 - protein, 39 aa, Artificial Sequence
  Description of Artificial Sequence: Synthetic polypeptide
DEEEISTTNPVAYEQYGQCVCSNWGEDHNAEYFNSENQF

SEQ ID NO: 203679 - protein, 39 aa, Artificial Sequence
  Description of Artificial Sequence: Synthetic polypeptide
DEEEISTTNPVAYEQYGQCVCSNWGEDHNAEYFNSENQS

SEQ ID NO: 203680 - protein, 39 aa, Artificial Sequence
  Description of Artificial Sequence: Synthetic polypeptide
DEEEISTTNPVAYEQYGQCVCSNWGEDHNEEHFNSQTQN

SEQ ID NO: 203681 - protein, 39 aa, Artificial Sequence
  Description of Artificial Sequence: Synthetic polypeptide
DEEEISTTNPVAYEQYGQCVCSNWGEDHNIEYFNSETQA

SEQ ID NO: 203682 - protein, 38 aa, Artificial Sequence
  Description of Artificial Sequence: Synthetic polypeptide
DQAEIRTTNPVATEQYGCYCSNWGEDHNQEHFNSDTQA

SEQ ID NO: 203683 - protein, 39 aa, Artificial Sequence
  Description of Artificial Sequence: Synthetic polypeptide
DEEEISTTNPVAYEQYGQCVCSNWGEDHNQEHFGSDTQS

SEQ ID NO: 203684 - protein, 38 aa, Artificial Sequence
  Description of Artificial Sequence: Synthetic polypeptide
SAEEIATTNPVAYEQYGSVPAIANNITMTAMPDGSENH

SEQ ID NO: 203685 - protein, 39 aa, Artificial Sequence
  Description of Artificial Sequence: Synthetic polypeptide
DEEEISTTNPVAYEQYGQCVCSNWGEDHNQENFGSETQA

SEQ ID NO: 203686 - protein, 37 aa, Artificial Sequence
  Description of Artificial Sequence: Synthetic polypeptide
DEEQIATTNPVATASWGANVAGTNHGPLASGEGAMTN

SEQ ID NO: 203687 - protein, 39 aa, Artificial Sequence
  Description of Artificial Sequence: Synthetic polypeptide
DEEEISTTNPVAYEQYGQCVCSNWGEDHNQENFNSDNQM

SEQ ID NO: 203688 - protein, 39 aa, Artificial Sequence
  Description of Artificial Sequence: Synthetic polypeptide
DEEEISTTNPVAYEQYGQCVCSNWGEDHNQENFNSETQS

SEQ ID NO: 203689 - protein, 39 aa, Artificial Sequence
  Description of Artificial Sequence: Synthetic polypeptide
DEEEISTTNPVAYEQYGQCVCSNWGEDHNTENFNSDTQS

SEQ ID NO: 203690 - protein, 38 aa, Artificial Sequence
  Description of Artificial Sequence: Synthetic polypeptide
DDEEISTTNPVAYEQYGCVCSNWGEDHNAEHFISENQA

SEQ ID NO: 203691 - protein, 38 aa, Artificial Sequence
  Description of Artificial Sequence: Synthetic polypeptide
DDEAIRCTNPVATEQYGCQVCSNWGEHNQENFGSDTQS

SEQ ID NO: 203692 - protein, 39 aa, Artificial Sequence
  Description of Artificial Sequence: Synthetic polypeptide
DEEEISTTNPVAYEQYGQCVCSNWGEDHNTEYFNSDTQS

SEQ ID NO: 203693 - protein, 39 aa, Artificial Sequence
  Description of Artificial Sequence: Synthetic polypeptide
DEEEISTTNPVAYEQYGQCVCSNWGEDPNAENFNSDTQA

SEQ ID NO: 203694 - protein, 38 aa, Artificial Sequence
  Description of Artificial Sequence: Synthetic polypeptide
DEEQIATTNPVATASWGCGWVAGTNHGPLASGEGNMTN

SEQ ID NO: 203695 - protein, 39 aa, Artificial Sequence
  Description of Artificial Sequence: Synthetic polypeptide
DEEEISTTNPVAYEQYGQCVCSNWVEDHNQENFNSDPQL

SEQ ID NO: 203696 - protein, 38 aa, Artificial Sequence
  Description of Artificial Sequence: Synthetic polypeptide
DEMEISTTNPVAYEQYGCVCSNSGEDHNAENFNSDNQS

SEQ ID NO: 203697 - protein, 38 aa, Artificial Sequence
  Description of Artificial Sequence: Synthetic polypeptide
DEEQIACTNPVATEQYGCSSAANTHGPEAGGNQMEHNN

SEQ ID NO: 203698 - protein, 38 aa, Artificial Sequence
  Description of Artificial Sequence: Synthetic polypeptide
DEEEISTTNPVAYEYYGCVCSNWGEDHNAENFNSDNQA

SEQ ID NO: 203699 - protein, 38 aa, Artificial Sequence
  Description of Artificial Sequence: Synthetic polypeptide
DEEEISTTNPVAYEYYGQCVCSNSGEHNAENFNSDTQQ

SEQ ID NO: 203700 - protein, 38 aa, Artificial Sequence
  Description of Artificial Sequence: Synthetic polypeptide
DEDELATTNPVAYEAWGSTVPTDIHGLTDNGGHRGQRK

SEQ ID NO: 203701 - protein, 38 aa, Artificial Sequence
  Description of Artificial Sequence: Synthetic polypeptide
DEMAISTTNPVATEQYGQCVCSNWGEHNAENFNSDFQA

SEQ ID NO: 203702 - protein, 36 aa, Artificial Sequence
  Description of Artificial Sequence: Synthetic polypeptide
SAEEIATTNPVAYEQWGCTTAGNGLVTTAEGGNMDN

SEQ ID NO: 203703 - protein, 40 aa, Artificial Sequence
  Description of Artificial Sequence: Synthetic polypeptide
DENEIRTTNPVATEQYGQASCNCVAGVVLLQEFVVQEDIN

SEQ ID NO: 203704 - protein, 38 aa, Artificial Sequence
  Description of Artificial Sequence: Synthetic polypeptide
DEEEISTTNPVCTEGYGQCVCSNWPEHNAENFGSDTQA

SEQ ID NO: 203705 - protein, 35 aa, Artificial Sequence
  Description of Artificial Sequence: Synthetic polypeptide
SAEEIATTNPVAYEQWGCNTAGNGLTTAEGGGMDG

SEQ ID NO: 203706 - protein, 37 aa, Artificial Sequence
  Description of Artificial Sequence: Synthetic polypeptide
SAEEIATTNPVAYEQYGSMCSMANPAGEATGGDLAAM

SEQ ID NO: 203707 - protein, 37 aa, Artificial Sequence
  Description of Artificial Sequence: Synthetic polypeptide
DEEEISTTNPVCTEHYGCVCGNWGEHNAENFGSDTQS

SEQ ID NO: 203708 - protein, 37 aa, Artificial Sequence
  Description of Artificial Sequence: Synthetic polypeptide
DEMEISTTNPVAYEQYGCVCQNWGADNIENFNSDTQS

SEQ ID NO: 203709 - protein, 37 aa, Artificial Sequence
  Description of Artificial Sequence: Synthetic polypeptide
DEEEISTTNPVCTEHYGCVCSNWPEHNQENFISDTQA

SEQ ID NO: 203710 - protein, 38 aa, Artificial Sequence
  Description of Artificial Sequence: Synthetic polypeptide
DEEEISTTNPVCTEHYGQCVCSNWGEDNQENFGSDTQA

SEQ ID NO: 203711 - protein, 40 aa, Artificial Sequence
  Description of Artificial Sequence: Synthetic polypeptide
DEEEIRTTNPVATEQYGQCQICSNWGEDHNEENFNSDFQS

SEQ ID NO: 203712 - protein, 38 aa, Artificial Sequence
  Description of Artificial Sequence: Synthetic polypeptide
DEEEISTTNPVGTEQYGCVCSNSGEDHNIENFISDTQA

SEQ ID NO: 203713 - protein, 38 aa, Artificial Sequence
  Description of Artificial Sequence: Synthetic polypeptide
DEMEISTTNPVAYEQYGCICSNWGEDTNAENFGSDTQS

SEQ ID NO: 203714 - protein, 36 aa, Artificial Sequence
  Description of Artificial Sequence: Synthetic polypeptide
CEEEIACTNPVATAQWGCVAGPGNSHQEADMLMTNA

SEQ ID NO: 203715 - protein, 37 aa, Artificial Sequence
  Description of Artificial Sequence: Synthetic polypeptide
DENEIRTTNPVATEEWGCVCSNSGEENAEYSISDTAS

SEQ ID NO: 203716 - protein, 35 aa, Artificial Sequence
  Description of Artificial Sequence: Synthetic polypeptide
DEHELATTNPVAYECWGTVYWINENQDRQAIHVGS

SEQ ID NO: 203717 - protein, 37 aa, Artificial Sequence
  Description of Artificial Sequence: Synthetic polypeptide
DEMEISTTNPVAYEQYGCVCQNWGEHNAENFDSDTQA

SEQ ID NO: 203718 - protein, 39 aa, Artificial Sequence
  Description of Artificial Sequence: Synthetic polypeptide
DEMEISTTNPVATEQYGQCVCSNWGEDHNAEFFNSDNQQ

SEQ ID NO: 203719 - protein, 40 aa, Artificial Sequence
  Description of Artificial Sequence: Synthetic polypeptide
DECEICTTNPVATEQYGVVSTVTTTNNNSEQGSTTDEEDE

SEQ ID NO: 203720 - protein, 38 aa, Artificial Sequence
  Description of Artificial Sequence: Synthetic polypeptide
DDEEISTTNPVAYEQYGCVCSNWGEDHNAESFNSDTQS

SEQ ID NO: 203721 - protein, 38 aa, Artificial Sequence
  Description of Artificial Sequence: Synthetic polypeptide
QEYEIVTTNPVATESYGSVVAPTTPIGPEMGQGENEEG

SEQ ID NO: 203722 - protein, 35 aa, Artificial Sequence
  Description of Artificial Sequence: Synthetic polypeptide
CEEVIACTNPVATEQWGCSNANMNNSNAAGGPGEQ

SEQ ID NO: 203723 - protein, 37 aa, Artificial Sequence
  Description of Artificial Sequence: Synthetic polypeptide
DQAEISTTNPVATEQYGCCCSNWEEHNQEHFGSDTQA

SEQ ID NO: 203724 - protein, 39 aa, Artificial Sequence
  Description of Artificial Sequence: Synthetic polypeptide
DEEEISTTNPVAYEQYGQCVCSTWGEDHNQENFISEFQA

SEQ ID NO: 203725 - protein, 38 aa, Artificial Sequence
  Description of Artificial Sequence: Synthetic polypeptide
CEEEISTTNPVATEGYGCVCSNWGEDHNQENFGSDTQS

SEQ ID NO: 203726 - protein, 38 aa, Artificial Sequence
  Description of Artificial Sequence: Synthetic polypeptide
DEMEISTTNPVAYEQYGCVCSNSGEDHNAENFNSDNQA

SEQ ID NO: 203727 - protein, 38 aa, Artificial Sequence
  Description of Artificial Sequence: Synthetic polypeptide
DEEEISTTNPVAYEQYGQCVCSWGEDHNIEYFISETQS

SEQ ID NO: 203728 - protein, 38 aa, Artificial Sequence
  Description of Artificial Sequence: Synthetic polypeptide
DEECISTTNPVATEQYGCVCSNWMEDHNAEYFISQTQS

SEQ ID NO: 203729 - protein, 37 aa, Artificial Sequence
  Description of Artificial Sequence: Synthetic polypeptide
CEEEISTTNPVATEGYGCVCSNWGEHNEENFISDTQE

SEQ ID NO: 203730 - protein, 40 aa, Artificial Sequence
  Description of Artificial Sequence: Synthetic polypeptide
DECEICTTNPVATEQYGVVSTVTTTQAGSEQGSTTDDQDE

SEQ ID NO: 203731 - protein, 35 aa, Artificial Sequence
  Description of Artificial Sequence: Synthetic polypeptide
SEEEIRTTNPIATECWGATTWANEEDWAEPKGPYI

SEQ ID NO: 203732 - protein, 35 aa, Artificial Sequence
  Description of Artificial Sequence: Synthetic polypeptide
SEEEIRTTNPIATECWGATTWANAEDWAEPKGPYI

SEQ ID NO: 203733 - protein, 38 aa, Artificial Sequence
  Description of Artificial Sequence: Synthetic polypeptide
DEEEISTTNPVAYEQYGQCVCSWMEDHNAENFMSDTQS

SEQ ID NO: 203734 - protein, 40 aa, Artificial Sequence
  Description of Artificial Sequence: Synthetic polypeptide
DENEIRTTNPVATEQYGQWGVVGIAEGGEEQDEGETNGEG

SEQ ID NO: 203735 - protein, 35 aa, Artificial Sequence
  Description of Artificial Sequence: Synthetic polypeptide
DELAIGTTNPVATEQYGCLWTATDGSPVEFETDKQ

SEQ ID NO: 203736 - protein, 38 aa, Artificial Sequence
  Description of Artificial Sequence: Synthetic polypeptide
DEEEISTTNPVAYEQYGQCVCYNWGEHNAENFNSDNQA

SEQ ID NO: 203737 - protein, 39 aa, Artificial Sequence
  Description of Artificial Sequence: Synthetic polypeptide
DEEEISTTNPVAYEQYGQCVTSTWGADHNAEHFISDPQS

SEQ ID NO: 203738 - protein, 37 aa, Artificial Sequence
  Description of Artificial Sequence: Synthetic polypeptide
DEMEISTTNPVAYEQYGCVCQNWGEPNAEFFISDTQA

SEQ ID NO: 203739 - protein, 39 aa, Artificial Sequence
  Description of Artificial Sequence: Synthetic polypeptide
DEEEISTTNPVAYEQYGQCVCSNWGEDHNAEYFNSDTQS

SEQ ID NO: 203740 - protein, 39 aa, Artificial Sequence
  Description of Artificial Sequence: Synthetic polypeptide
DEEEISTTNPVAYEQYGQCVCSNWGEDHNAEYFNSDTQL

SEQ ID NO: 203741 - protein, 38 aa, Artificial Sequence
  Description of Artificial Sequence: Synthetic polypeptide
DDEEISTTNPVAYEQYGCVCSNWGEDHNAEFFNSDTQA

SEQ ID NO: 203742 - protein, 38 aa, Artificial Sequence
  Description of Artificial Sequence: Synthetic polypeptide
DDAEISTTNPVATEQYGCSCSNWGEDHNAEHFGSDTQA

SEQ ID NO: 203743 - protein, 39 aa, Artificial Sequence
  Description of Artificial Sequence: Synthetic polypeptide
DEEEISTTNPVAYEQYGQCVCSNSGEDHNAEYFNSETQA

SEQ ID NO: 203744 - protein, 37 aa, Artificial Sequence
  Description of Artificial Sequence: Synthetic polypeptide
CEEEIACTNPVATEPYGSACSAGPHLNNEAPGGQMHN

SEQ ID NO: 203745 - protein, 36 aa, Artificial Sequence
  Description of Artificial Sequence: Synthetic polypeptide
DQAEIKTTNPVAYEPYGQCTASCIMELVKTGTANVT

SEQ ID NO: 203746 - protein, 38 aa, Artificial Sequence
  Description of Artificial Sequence: Synthetic polypeptide
QEVEITTTNPVATEQYGTVVVATDGGDEEEEEGGNNAI

SEQ ID NO: 203747 - protein, 37 aa, Artificial Sequence
  Description of Artificial Sequence: Synthetic polypeptide
DQAEIKTTNPVAYEQYGQCTAPQCIMELVQTGTANVT

SEQ ID NO: 203748 - protein, 39 aa, Artificial Sequence
  Description of Artificial Sequence: Synthetic polypeptide
DEAEISTTNPVATEQYGQCVCSNWGEDHNAENFISDNQS

SEQ ID NO: 203749 - protein, 38 aa, Artificial Sequence
  Description of Artificial Sequence: Synthetic polypeptide
DDEEISTTNPVAYEGYGCVCSNWGEDHNAENFGSENQS

SEQ ID NO: 203750 - protein, 37 aa, Artificial Sequence
  Description of Artificial Sequence: Synthetic polypeptide
DDEEISTTNPVAYEGYGCVCSNWGEHNAENFNSETQA

SEQ ID NO: 203751 - protein, 35 aa, Artificial Sequence
  Description of Artificial Sequence: Synthetic polypeptide
DSNEIRTTNPVSYEPWGKISCMEDISQQQNGGNFK

SEQ ID NO: 203752 - protein, 39 aa, Artificial Sequence
  Description of Artificial Sequence: Synthetic polypeptide
DEAEISTTNPVATEQYGQCVCSNWGEDHNAENFISDNQA

SEQ ID NO: 203753 - protein, 39 aa, Artificial Sequence
  Description of Artificial Sequence: Synthetic polypeptide
DEEEISTTNPVAYEQYGQCVCSNWEEDHNAEGFNSDTQG

SEQ ID NO: 203754 - protein, 39 aa, Artificial Sequence
  Description of Artificial Sequence: Synthetic polypeptide
DEEEISTTNPVAYEQYGQCVCSNWEEDHNAEGFNSQTQS

SEQ ID NO: 203755 - protein, 39 aa, Artificial Sequence
  Description of Artificial Sequence: Synthetic polypeptide
FEEEIRSTNPVATEQYGVVVLSGFQGQIGQDGGEEQTQG

SEQ ID NO: 203756 - protein, 38 aa, Artificial Sequence
  Description of Artificial Sequence: Synthetic polypeptide
DEEEISTTNPVAYEQYGQCVCSNWEEHNQENFISEFQS

SEQ ID NO: 203757 - protein, 39 aa, Artificial Sequence
  Description of Artificial Sequence: Synthetic polypeptide
DEEEISTTNPVAYEQYGQCVCSNWEPDDNAENFNSETQS

SEQ ID NO: 203758 - protein, 39 aa, Artificial Sequence
  Description of Artificial Sequence: Synthetic polypeptide
DEEEISTTNPVAYEQYGQCVCSNWGEAHNAENFNSENQI

SEQ ID NO: 203759 - protein, 39 aa, Artificial Sequence
  Description of Artificial Sequence: Synthetic polypeptide
DEEEISTTNPVAYEQYGQCVCSNWGEDDNAEFFNSDTQS

SEQ ID NO: 203760 - protein, 39 aa, Artificial Sequence
  Description of Artificial Sequence: Synthetic polypeptide
DEEEISTTNPVAYEQYGQCVCSNWGEDDNAEHFNSEFQA

SEQ ID NO: 203761 - protein, 39 aa, Artificial Sequence
  Description of Artificial Sequence: Synthetic polypeptide
DEEEISTTNPVAYEQYGQCVCSNWEEDHNAEFFQSDTQS

SEQ ID NO: 203762 - protein, 39 aa, Artificial Sequence
  Description of Artificial Sequence: Synthetic polypeptide
DEEEISTTNPVAYEQYGQCVCSNSGEDHNAENFISDNQA

SEQ ID NO: 203763 - protein, 39 aa, Artificial Sequence
  Description of Artificial Sequence: Synthetic polypeptide
DEECISTTNPVATEQYGQCVCGNWGEDHNEEGFNSDTQS

SEQ ID NO: 203764 - protein, 39 aa, Artificial Sequence
  Description of Artificial Sequence: Synthetic polypeptide
DEAEIRTTNPVATEQYGQCVCENWEEDHNEENFNSDTQA

SEQ ID NO: 203765 - protein, 39 aa, Artificial Sequence
  Description of Artificial Sequence: Synthetic polypeptide
DEECISTTNPVATEQYGQCVCPNWGEDHNQENFNSDTQN

SEQ ID NO: 203766 - protein, 39 aa, Artificial Sequence
  Description of Artificial Sequence: Synthetic polypeptide
DEECISTTNPVATEQYGQCVCPNWGEDHNQENFNSDTQA

SEQ ID NO: 203767 - protein, 36 aa, Artificial Sequence
  Description of Artificial Sequence: Synthetic polypeptide
DSPEIATTNPVAYEHWGCSVTQQNMHSMNASGNEYI

SEQ ID NO: 203768 - protein, 35 aa, Artificial Sequence
  Description of Artificial Sequence: Synthetic polypeptide
DSPCIATTNPVAYEEWGSVTQQNEHSMNASGNEYK

SEQ ID NO: 203769 - protein, 39 aa, Artificial Sequence
  Description of Artificial Sequence: Synthetic polypeptide
DEEEISTTNPVAYEQYGQCVCSMWGEDHNAENFGSDTQD

SEQ ID NO: 203770 - protein, 39 aa, Artificial Sequence
  Description of Artificial Sequence: Synthetic polypeptide
DEEEISTTNPVAYEQYGQCVCSMWGEDHNAENFNSQTQA

SEQ ID NO: 203771 - protein, 39 aa, Artificial Sequence
  Description of Artificial Sequence: Synthetic polypeptide
DEEEISTTNPVAYEQYGQCVCSMWGEDHNQEYFISDNQS

SEQ ID NO: 203772 - protein, 39 aa, Artificial Sequence
  Description of Artificial Sequence: Synthetic polypeptide
DEEEISTTNPVAYEQYGQCVCSMWGEDHNTENFISQTQS

SEQ ID NO: 203773 - protein, 38 aa, Artificial Sequence
  Description of Artificial Sequence: Synthetic polypeptide
DEEEISTTNPVAYEQYGQCVCSMWGEHNQENFSSDTQS

SEQ ID NO: 203774 - protein, 37 aa, Artificial Sequence
  Description of Artificial Sequence: Synthetic polypeptide
CEEEISTTNPVATCQYGCVCSNWGEDHAEHFNSDTQS

SEQ ID NO: 203775 - protein, 39 aa, Artificial Sequence
  Description of Artificial Sequence: Synthetic polypeptide
DEAEIRTTNPVATEQYGQCVCQNWGEDHNAENFNSETQS

SEQ ID NO: 203776 - protein, 38 aa, Artificial Sequence
  Description of Artificial Sequence: Synthetic polypeptide
DEECISTTNPVATEQYGQCVCGNWGEPNAENFNSETQP

SEQ ID NO: 203777 - protein, 39 aa, Artificial Sequence
  Description of Artificial Sequence: Synthetic polypeptide
DEAEIRTTNPVATEQYGQCVCGNWGEDHNAENFNSETQS

SEQ ID NO: 203778 - protein, 38 aa, Artificial Sequence
  Description of Artificial Sequence: Synthetic polypeptide
SEEEIRTTNPVATEGYGCVCSNWEEDHNAENFISDTQA

SEQ ID NO: 203779 - protein, 39 aa, Artificial Sequence
  Description of Artificial Sequence: Synthetic polypeptide
DEEEISTTNPVAYEQYGQCVCSMWGELHNAENFNSDTQA

SEQ ID NO: 203780 - protein, 39 aa, Artificial Sequence
  Description of Artificial Sequence: Synthetic polypeptide
DEEEISTTNPVAYEQYGQCVCSMWMEDHNAENFNSETQA

SEQ ID NO: 203781 - protein, 39 aa, Artificial Sequence
  Description of Artificial Sequence: Synthetic polypeptide
DEEEISTTNPVAYEQYGQCVCSMWPEDHNAENFNSDTQS

SEQ ID NO: 203782 - protein, 39 aa, Artificial Sequence
  Description of Artificial Sequence: Synthetic polypeptide
DEEEISTTNPVAYEQYGQCVCSNSGEAHNAENFNSDNQG

SEQ ID NO: 203783 - protein, 39 aa, Artificial Sequence
  Description of Artificial Sequence: Synthetic polypeptide
DEEEISTTNPVAYEQYGQCVCSNSGEDHNAEHFNSDTQD

SEQ ID NO: 203784 - protein, 38 aa, Artificial Sequence
  Description of Artificial Sequence: Synthetic polypeptide
DQAEIRTTNPVATCQYGCVCSNWGEDDNAENFISDNQS

SEQ ID NO: 203785 - protein, 39 aa, Artificial Sequence
  Description of Artificial Sequence: Synthetic polypeptide
DEECISTTNPVATEQYGQCVCQNSGEDHNAENFNSDTQS

SEQ ID NO: 203786 - protein, 37 aa, Artificial Sequence
  Description of Artificial Sequence: Synthetic polypeptide
DEAEIATTNPVATEQWGCCAGTGDHPGNNHPDDSFNN

SEQ ID NO: 203787 - protein, 40 aa, Artificial Sequence
  Description of Artificial Sequence: Synthetic polypeptide
DEECISTTNPVATEQYGQCQVCSNWGEDTNAENFNSDNQS

SEQ ID NO: 203788 - protein, 35 aa, Artificial Sequence
  Description of Artificial Sequence: Synthetic polypeptide
TEDEIASVNPVCYEPYGVTVNTINLLSTAAGGNNV

SEQ ID NO: 203789 - protein, 37 aa, Artificial Sequence
  Description of Artificial Sequence: Synthetic polypeptide
CEEEISTTNPVATEGYGCVCSNWGEDHAENFGSDPQP

SEQ ID NO: 203790 - protein, 38 aa, Artificial Sequence
  Description of Artificial Sequence: Synthetic polypeptide
DDAEISTTNPVATEGYGQCVCSNWGETNAENFNSETQS

SEQ ID NO: 203791 - protein, 39 aa, Artificial Sequence
  Description of Artificial Sequence: Synthetic polypeptide
DEMEISTTNPVATEQYGQCVCSNSGEDHNAEGFNSDTQS

SEQ ID NO: 203792 - protein, 38 aa, Artificial Sequence
  Description of Artificial Sequence: Synthetic polypeptide
CEEEISTTNPVATEGYGCVCSNWGEDHNAENFNSDNQA

SEQ ID NO: 203793 - protein, 35 aa, Artificial Sequence
  Description of Artificial Sequence: Synthetic polypeptide
CEEEIACTNPVATAQWGHSASLAGMGITAEDPNEN

SEQ ID NO: 203794 - protein, 38 aa, Artificial Sequence
  Description of Artificial Sequence: Synthetic polypeptide
CEEEISTTNPVATEGYGCVCSNWGEDHNAENFNSDTQS

SEQ ID NO: 203795 - protein, 37 aa, Artificial Sequence
  Description of Artificial Sequence: Synthetic polypeptide
CEEEIACTNPVATAQWGHSASLAGMGIQTAGDPNENT

SEQ ID NO: 203796 - protein, 37 aa, Artificial Sequence
  Description of Artificial Sequence: Synthetic polypeptide
CEEEISTTNPVATEGYGCVCQNWGEHNAENFNSETQS

SEQ ID NO: 203797 - protein, 39 aa, Artificial Sequence
  Description of Artificial Sequence: Synthetic polypeptide
DEEEISTTNPVAYEQYGQCVCSNWGEDHNAENFNSDNQA

SEQ ID NO: 203798 - protein, 39 aa, Artificial Sequence
  Description of Artificial Sequence: Synthetic polypeptide
DEEEISTTNPVAYEQYGQCVCSNWGEDHNAENFNSDTQS

SEQ ID NO: 203799 - protein, 40 aa, Artificial Sequence
  Description of Artificial Sequence: Synthetic polypeptide
DEAEIRTTNPVATEQYGQCQVCSNWGEDHNTEGFNSENQS

SEQ ID NO: 203800 - protein, 38 aa, Artificial Sequence
  Description of Artificial Sequence: Synthetic polypeptide
DEAEIRTTNPVATEQYGQCFCSNWGEHNAENFSSDTQS

SEQ ID NO: 203801 - protein, 39 aa, Artificial Sequence
  Description of Artificial Sequence: Synthetic polypeptide
DEEEISTTNPVAYEQYGQCVCSNWGEDHNAEYFNSDNQA

SEQ ID NO: 203802 - protein, 37 aa, Artificial Sequence
  Description of Artificial Sequence: Synthetic polypeptide
FEEEIRTTNPNAKEDWYGGVNALTMYDQPQPQSVDNF

SEQ ID NO: 203803 - protein, 39 aa, Artificial Sequence
  Description of Artificial Sequence: Synthetic polypeptide
DEEEISTTNPVAYEQYGQCVCSNWGEDHNAEYFNSDNQS

SEQ ID NO: 203804 - protein, 39 aa, Artificial Sequence
  Description of Artificial Sequence: Synthetic polypeptide
DEEEISTTNPVAYEQYGQCVCSNWGEDHNAEYFNSDTQA

SEQ ID NO: 203805 - protein, 39 aa, Artificial Sequence
  Description of Artificial Sequence: Synthetic polypeptide
DEEEISTTNPVAYEQYGQCVCSNWGEDHNAEYFNSDTQD

SEQ ID NO: 203806 - protein, 39 aa, Artificial Sequence
  Description of Artificial Sequence: Synthetic polypeptide
DEEEISTTNPVAYEQYGQCVCSNWGEDHNAENFNSDTQA

SEQ ID NO: 203807 - protein, 39 aa, Artificial Sequence
  Description of Artificial Sequence: Synthetic polypeptide
DEEEISTTNPVAYEQYGQCVCSNWGEDHNAENFISDNQA

SEQ ID NO: 203808 - protein, 39 aa, Artificial Sequence
  Description of Artificial Sequence: Synthetic polypeptide
DEEEISTTNPVAYEQYGQCVCSNWGEDHNAENFGSETQG

SEQ ID NO: 203809 - protein, 39 aa, Artificial Sequence
  Description of Artificial Sequence: Synthetic polypeptide
DEEEISTTNPVAYEQYGQCVCSNWGEDHNAENFGSDTQA

SEQ ID NO: 203810 - protein, 39 aa, Artificial Sequence
  Description of Artificial Sequence: Synthetic polypeptide
DEEEISTTNPVAYEQYGQCVCSNWGEDDNAENFNSDNQA

SEQ ID NO: 203811 - protein, 37 aa, Artificial Sequence
  Description of Artificial Sequence: Synthetic polypeptide
DEMEISTTNPVAYEQYGCVCSNWGEPNEEFFISDTQS

SEQ ID NO: 203812 - protein, 35 aa, Artificial Sequence
  Description of Artificial Sequence: Synthetic polypeptide
DEIEIRTTNPIATECWGATTWANAEDWAEPKGPYI

SEQ ID NO: 203813 - protein, 38 aa, Artificial Sequence
  Description of Artificial Sequence: Synthetic polypeptide
CEEEIACTNPVATAQYGSACSAANPAEVADAEIGENTA

SEQ ID NO: 203814 - protein, 39 aa, Artificial Sequence
  Description of Artificial Sequence: Synthetic polypeptide
DEEEISTTNPVAYEQYGQCVCSNWGEDDNAENFNSDTQA

SEQ ID NO: 203815 - protein, 39 aa, Artificial Sequence
  Description of Artificial Sequence: Synthetic polypeptide
DEECISTTNPVATEQYGQCAVCSNWGEHNQENFGSDTQS

SEQ ID NO: 203816 - protein, 39 aa, Artificial Sequence
  Description of Artificial Sequence: Synthetic polypeptide
DEEEISTTNPVAYEQYGQCVCSNWGEDDNAENFNSDTQG

SEQ ID NO: 203817 - protein, 39 aa, Artificial Sequence
  Description of Artificial Sequence: Synthetic polypeptide
DEEEISTTNPVAYEQYGQCVCSNWGEDDNAENFNSDTQS

SEQ ID NO: 203818 - protein, 39 aa, Artificial Sequence
  Description of Artificial Sequence: Synthetic polypeptide
DEEEISTTNPVAYEQYGQCVCSNWGEDDNAENFNSETQS

SEQ ID NO: 203819 - protein, 39 aa, Artificial Sequence
  Description of Artificial Sequence: Synthetic polypeptide
DEEEISTTNPVAYEQYGQCVCSNWGEDDNEEHFNSDTQA

SEQ ID NO: 203820 - protein, 39 aa, Artificial Sequence
  Description of Artificial Sequence: Synthetic polypeptide
DEEEISTTNPVAYEQYGQCVCSNWGEDDNIENFNSDNQI

SEQ ID NO: 203821 - protein, 39 aa, Artificial Sequence
  Description of Artificial Sequence: Synthetic polypeptide
DEEEISTTNPVAYEQYGQCVCSNWGEDDNQENFGSETQG

SEQ ID NO: 203822 - protein, 38 aa, Artificial Sequence
  Description of Artificial Sequence: Synthetic polypeptide
DEEEISTTNPVAYEQYGQCVCSNWGEDDNQNFISETQA

SEQ ID NO: 203823 - protein, 39 aa, Artificial Sequence
  Description of Artificial Sequence: Synthetic polypeptide
DEEEISTTNPVAYEQYGQCVCSNWGEDHNAEFFGSDTQA

SEQ ID NO: 203824 - protein, 39 aa, Artificial Sequence
  Description of Artificial Sequence: Synthetic polypeptide
DEEEISTTNPVAYEQYGQCVCSNWGEDHNAEGFNSDNQA

SEQ ID NO: 203825 - protein, 39 aa, Artificial Sequence
  Description of Artificial Sequence: Synthetic polypeptide
DEEEISTTNPVAYEQYGQCVCSNWGEDHNAEGFNSDTQA

SEQ ID NO: 203826 - protein, 39 aa, Artificial Sequence
  Description of Artificial Sequence: Synthetic polypeptide
DEEEISTTNPVAYEQYGQCVCSNWGEDHNAEHFNSDNQS

SEQ ID NO: 203827 - protein, 36 aa, Artificial Sequence
  Description of Artificial Sequence: Synthetic polypeptide
CEEEIACTNPVATAQWGHSASSLANMGPTAEDPNEN

SEQ ID NO: 203828 - protein, 39 aa, Artificial Sequence
  Description of Artificial Sequence: Synthetic polypeptide
DEEEISTTNPVAYEQYGQCVCSNWGEDHNAEHFNSDTQS

SEQ ID NO: 203829 - protein, 38 aa, Artificial Sequence
  Description of Artificial Sequence: Synthetic polypeptide
CEEEIACTNPVATEPYGSACSAANPAEDADAEIGENTA

SEQ ID NO: 203830 - protein, 37 aa, Artificial Sequence
  Description of Artificial Sequence: Synthetic polypeptide
DEECISTTNPVAYEQYGCVCGNWGEHNAENFNSETQS

SEQ ID NO: 203831 - protein, 37 aa, Artificial Sequence
  Description of Artificial Sequence: Synthetic polypeptide
CEEEIACTNPVAYEQWGCVPNKTNANNGNITAEDPMD

SEQ ID NO: 203832 - protein, 37 aa, Artificial Sequence
  Description of Artificial Sequence: Synthetic polypeptide
DEECISTTNPVAYEQYGCVCQNWGEHNAEYFDSDTQS

SEQ ID NO: 203833 - protein, 35 aa, Artificial Sequence
  Description of Artificial Sequence: Synthetic polypeptide
DETEIRTTNPIATEGWGATTWANAEDWAEPKGPYI

SEQ ID NO: 203834 - protein, 37 aa, Artificial Sequence
  Description of Artificial Sequence: Synthetic polypeptide
SEEEIACTNPVATAQWGGCVAGTGMPLGIHGDDNDPH

SEQ ID NO: 203835 - protein, 35 aa, Artificial Sequence
  Description of Artificial Sequence: Synthetic polypeptide
DETEIRTTNPIATEGWGATTWANAEDWKEPKGPYI

SEQ ID NO: 203836 - protein, 36 aa, Artificial Sequence
  Description of Artificial Sequence: Synthetic polypeptide
SEEEIACTNPVATAQWGHSASVAGMGQSAEDPLENW

SEQ ID NO: 203837 - protein, 40 aa, Artificial Sequence
  Description of Artificial Sequence: Synthetic polypeptide
DEAEIRTTNPVATEGYGQCAVCSTWEEDHNAENFNSEFQS

SEQ ID NO: 203838 - protein, 35 aa, Artificial Sequence
  Description of Artificial Sequence: Synthetic polypeptide
DETEIRTTNPIATEGWGATTWANAEDWTEPKGPYI

SEQ ID NO: 203839 - protein, 36 aa, Artificial Sequence
  Description of Artificial Sequence: Synthetic polypeptide
DETEIRTTNPIATEGWGCITCANSEDDAENSGSDNI

SEQ ID NO: 203840 - protein, 35 aa, Artificial Sequence
  Description of Artificial Sequence: Synthetic polypeptide
DETEIRTTNPIATEGWGCQTCANAEAHAEYSGETI

SEQ ID NO: 203841 - protein, 35 aa, Artificial Sequence
  Description of Artificial Sequence: Synthetic polypeptide
DETEIRTTNPIATEGWGCQTCANAEDHAEGSGETQ

SEQ ID NO: 203842 - protein, 35 aa, Artificial Sequence
  Description of Artificial Sequence: Synthetic polypeptide
DETEIRTTNPIATEGWGCQTCFNAEDHAESSGETI

SEQ ID NO: 203843 - protein, 37 aa, Artificial Sequence
  Description of Artificial Sequence: Synthetic polypeptide
CEEEIACTNPVAYEQYGSTCAAGPALGINHQMGMQMN

SEQ ID NO: 203844 - protein, 35 aa, Artificial Sequence
  Description of Artificial Sequence: Synthetic polypeptide
DETEIRTTNPIATEGWGCQTCGNAEEPAEYSGETI

SEQ ID NO: 203845 - protein, 39 aa, Artificial Sequence
  Description of Artificial Sequence: Synthetic polypeptide
DEAEIRTTNPVATEGYGQCVCSNWGEDHNEEGFNSETQA

SEQ ID NO: 203846 - protein, 37 aa, Artificial Sequence
  Description of Artificial Sequence: Synthetic polypeptide
DDECISTTNPVATEQYGCVCSNWGEHNIENFISDTQA

SEQ ID NO: 203847 - protein, 35 aa, Artificial Sequence
  Description of Artificial Sequence: Synthetic polypeptide
DETEIRTTNPIATEGWGCQTCQNAEDPAENSGEYI

SEQ ID NO: 203848 - protein, 38 aa, Artificial Sequence
  Description of Artificial Sequence: Synthetic polypeptide
DEAEIRTTNPVATEGYGSSCPLAIVAEVAETQVFQEMP

SEQ ID NO: 203849 - protein, 39 aa, Artificial Sequence
  Description of Artificial Sequence: Synthetic polypeptide
DDEEIRTTNPVAYEGYGQCVCSMWGEDTNAENFNSENQP

SEQ ID NO: 203850 - protein, 35 aa, Artificial Sequence
  Description of Artificial Sequence: Synthetic polypeptide
DETEIRTTNPIATEGWGATTWANAEDWAEPKGPLI

SEQ ID NO: 203851 - protein, 35 aa, Artificial Sequence
  Description of Artificial Sequence: Synthetic polypeptide
DETEIRTTNPIATEGWGCTTCANAEDHAENSGEPI

SEQ ID NO: 203852 - protein, 35 aa, Artificial Sequence
  Description of Artificial Sequence: Synthetic polypeptide
DETEIRTTNPIATEGWGATTWANAEDWAEKKGPYI

SEQ ID NO: 203853 - protein, 35 aa, Artificial Sequence
  Description of Artificial Sequence: Synthetic polypeptide
DETEIRTTNPIATEGWGATTPANCEDWAEIVGPDI

SEQ ID NO: 203854 - protein, 36 aa, Artificial Sequence
  Description of Artificial Sequence: Synthetic polypeptide
SQEEIRTTNPVATEHWGTMYSSWINETETFPINVKT

SEQ ID NO: 203855 - protein, 38 aa, Artificial Sequence
  Description of Artificial Sequence: Synthetic polypeptide
SQEEIRTTNPVATEGWGQCVCSNWGEHNQENFGSDNQA

SEQ ID NO: 203856 - protein, 35 aa, Artificial Sequence
  Description of Artificial Sequence: Synthetic polypeptide
DETEIRTTNPIATEEWGATTWANAEDWAEPKGRYI

SEQ ID NO: 203857 - protein, 35 aa, Artificial Sequence
  Description of Artificial Sequence: Synthetic polypeptide
DETEIRTTNPIATEEWGATTWANAEDWAETKGPYI

SEQ ID NO: 203858 - protein, 36 aa, Artificial Sequence
  Description of Artificial Sequence: Synthetic polypeptide
DETEIRTTNPIATEEWGATTWANAEDWQAEPKGPYI

SEQ ID NO: 203859 - protein, 35 aa, Artificial Sequence
  Description of Artificial Sequence: Synthetic polypeptide
DETEIRTTNPIATEEWGATTWANHEDWAEPKGPYI

SEQ ID NO: 203860 - protein, 37 aa, Artificial Sequence
  Description of Artificial Sequence: Synthetic polypeptide
DEAEIATTNPVAYEQYGCTIPNNNVGPCEASINEQTS

SEQ ID NO: 203861 - protein, 35 aa, Artificial Sequence
  Description of Artificial Sequence: Synthetic polypeptide
DETEIRTTNPIATEEWGCQTCANAEDHAEHSGEPI

SEQ ID NO: 203862 - protein, 36 aa, Artificial Sequence
  Description of Artificial Sequence: Synthetic polypeptide
DETEIRTTNPIATEEWGCQTCANWEDHAEYSGSDNI

SEQ ID NO: 203863 - protein, 36 aa, Artificial Sequence
  Description of Artificial Sequence: Synthetic polypeptide
DETEIRTTNPIATEEWGCQTCFNAEDDAENSGSENI

SEQ ID NO: 203864 - protein, 36 aa, Artificial Sequence
  Description of Artificial Sequence: Synthetic polypeptide
DETEIRTTNPIATEEWGCQTCGNAEDHAEYSGSDNQ

SEQ ID NO: 203865 - protein, 36 aa, Artificial Sequence
  Description of Artificial Sequence: Synthetic polypeptide
DETEIRTTNPIATEEWGCQTCQNAEDDAENSGSDNQ

SEQ ID NO: 203866 - protein, 34 aa, Artificial Sequence
  Description of Artificial Sequence: Synthetic polypeptide
DEEEIATTNPIATECWGATWANAEDWAEPKEPYI

SEQ ID NO: 203867 - protein, 35 aa, Artificial Sequence
  Description of Artificial Sequence: Synthetic polypeptide
DETEIRTTNPIATEFWGATTWANAEDWAEPKGPYI

SEQ ID NO: 203868 - protein, 38 aa, Artificial Sequence
  Description of Artificial Sequence: Synthetic polypeptide
DEAEISTTNPVAYEQYGQCVCSMSEEHNAESFNSDNQA

SEQ ID NO: 203869 - protein, 35 aa, Artificial Sequence
  Description of Artificial Sequence: Synthetic polypeptide
DETEIRTTNPIATEFWGATTWANAEDWAEPKGPYQ

SEQ ID NO: 203870 - protein, 35 aa, Artificial Sequence
  Description of Artificial Sequence: Synthetic polypeptide
DETEIRTTNPIATEGWGATTCANAEDWAEPSGPYI

SEQ ID NO: 203871 - protein, 36 aa, Artificial Sequence
  Description of Artificial Sequence: Synthetic polypeptide
SEEEIACTNPVATAAWGGCVAGTGMLGIEHGDDNPH

SEQ ID NO: 203872 - protein, 35 aa, Artificial Sequence
  Description of Artificial Sequence: Synthetic polypeptide
DETEIRTTNPIATEHWGATTWANAEDWAELKGPYI

SEQ ID NO: 203873 - protein, 35 aa, Artificial Sequence
  Description of Artificial Sequence: Synthetic polypeptide
DETEIRTTNPIATEHWGATTWANAEDWAEPKGPYI

SEQ ID NO: 203874 - protein, 36 aa, Artificial Sequence
  Description of Artificial Sequence: Synthetic polypeptide
DETEIRTTNPIATEHWGCQTCANAEEDAENSGSDNI

SEQ ID NO: 203875 - protein, 37 aa, Artificial Sequence
  Description of Artificial Sequence: Synthetic polypeptide
LNDEIRCTNPVATEQYGSVFIVSHAEDEWEGQMEDWT

SEQ ID NO: 203876 - protein, 37 aa, Artificial Sequence
  Description of Artificial Sequence: Synthetic polypeptide
LNDEIRCTNPVATEQYGSAFTVSWAEDEWEGQMEDWT

SEQ ID NO: 203877 - protein, 36 aa, Artificial Sequence
  Description of Artificial Sequence: Synthetic polypeptide
DETEIRTTNPIATEPWGATTWANAEDIQAEQKGPYI

SEQ ID NO: 203878 - protein, 35 aa, Artificial Sequence
  Description of Artificial Sequence: Synthetic polypeptide
DETEIRTTNPIATEPWGATTWANAEDWAEPKGPHI

SEQ ID NO: 203879 - protein, 37 aa, Artificial Sequence
  Description of Artificial Sequence: Synthetic polypeptide
LNDEICTTNPVATEQYGSVFIVSGAEDEVEGQMEDPQ

SEQ ID NO: 203880 - protein, 35 aa, Artificial Sequence
  Description of Artificial Sequence: Synthetic polypeptide
DETEIRTTNPIATEPWGATTWANAEDWAEPKGPYI

SEQ ID NO: 203881 - protein, 35 aa, Artificial Sequence
  Description of Artificial Sequence: Synthetic polypeptide
DETEIRTTNPIATEPWGATTWANHEDWAEPKGPYI

SEQ ID NO: 203882 - protein, 38 aa, Artificial Sequence
  Description of Artificial Sequence: Synthetic polypeptide
SEAEISTTNPVATEQYGQCVCSNWGEHNAENFNSETQS

SEQ ID NO: 203883 - protein, 38 aa, Artificial Sequence
  Description of Artificial Sequence: Synthetic polypeptide
SEAEISTTNPVATEQYGQCVCSNWGEHNAENFNSDTQS

SEQ ID NO: 203884 - protein, 38 aa, Artificial Sequence
  Description of Artificial Sequence: Synthetic polypeptide
SEAEISTTNPVATEQYGQCVCSNWGEDNAENFNSDFQA

SEQ ID NO: 203885 - protein, 36 aa, Artificial Sequence
  Description of Artificial Sequence: Synthetic polypeptide
DETEIRTTNPIATEPWGVTTPACAEDWSNEPTGPYI

SEQ ID NO: 203886 - protein, 36 aa, Artificial Sequence
  Description of Artificial Sequence: Synthetic polypeptide
DAAEIATTNPVAYEQWGTTSAGTGPAGNPHGDNGFP

SEQ ID NO: 203887 - protein, 37 aa, Artificial Sequence
  Description of Artificial Sequence: Synthetic polypeptide
DEECLRTTNPCAYEQYGCVCSMWGEDDNQENFGSDQS

SEQ ID NO: 203888 - protein, 35 aa, Artificial Sequence
  Description of Artificial Sequence: Synthetic polypeptide
DETEIRTTNPIATEQWGATTWAAADGPVAEFKGPI

SEQ ID NO: 203889 - protein, 36 aa, Artificial Sequence
  Description of Artificial Sequence: Synthetic polypeptide
DETEIRTTNPIATEQWGATTWANADDPVAEFKGPYI

SEQ ID NO: 203890 - protein, 36 aa, Artificial Sequence
  Description of Artificial Sequence: Synthetic polypeptide
DAAEIATTNPVAYEQWGTTSAGTGPAGGNPHQDEGM

SEQ ID NO: 203891 - protein, 37 aa, Artificial Sequence
  Description of Artificial Sequence: Synthetic polypeptide
DEAEISTTNPVAYEQYGCICSNWGEDNEEYFNSDNQS

SEQ ID NO: 203892 - protein, 37 aa, Artificial Sequence
  Description of Artificial Sequence: Synthetic polypeptide
LNDEIRTTNPVATEQYGCVFIVSAEDEWVEGQMEDPQ

SEQ ID NO: 203893 - protein, 38 aa, Artificial Sequence
  Description of Artificial Sequence: Synthetic polypeptide
SEAEISTTNPVATEQYGQCVCSNWGEHNQENFNSDTQS

SEQ ID NO: 203894 - protein, 35 aa, Artificial Sequence
  Description of Artificial Sequence: Synthetic polypeptide
SEEEIACTNPVATEQWGCIAGTGGHADAEIGEEAD

SEQ ID NO: 203895 - protein, 37 aa, Artificial Sequence
  Description of Artificial Sequence: Synthetic polypeptide
DEMCIRTTNPLATEQWGCVCSNWGEHNAESFNSDTQA

SEQ ID NO: 203896 - protein, 37 aa, Artificial Sequence
  Description of Artificial Sequence: Synthetic polypeptide
SEEEIACTNPVATEMWGSVVANMGAPGNTHGGNTEMW

SEQ ID NO: 203897 - protein, 39 aa, Artificial Sequence
  Description of Artificial Sequence: Synthetic polypeptide
AEAEIRTTNPVATEQYGQCVCSNWGEDHNTENFNSDTQA

SEQ ID NO: 203898 - protein, 39 aa, Artificial Sequence
  Description of Artificial Sequence: Synthetic polypeptide
AEAEIRTTNPVATEQYGQCVCSNWGEDHNAENFNSDTQS

SEQ ID NO: 203899 - protein, 39 aa, Artificial Sequence
  Description of Artificial Sequence: Synthetic polypeptide
AEAEIRTTNPVATEQYGQCVCSNWGEDHNAENFNSDNQS

SEQ ID NO: 203900 - protein, 35 aa, Artificial Sequence
  Description of Artificial Sequence: Synthetic polypeptide
DETEIRTTNPIATEHWGNTTWANAEDWAEPKGPYI

SEQ ID NO: 203901 - protein, 36 aa, Artificial Sequence
  Description of Artificial Sequence: Synthetic polypeptide
DETEIRTTNPIATEIWGCQTCGNAEDDAEYSGSDNI

SEQ ID NO: 203902 - protein, 35 aa, Artificial Sequence
  Description of Artificial Sequence: Synthetic polypeptide
DETEIRTTNPIATEKWGATTWANAEDWAEPKGPYI

SEQ ID NO: 203903 - protein, 39 aa, Artificial Sequence
  Description of Artificial Sequence: Synthetic polypeptide
AEAEIRTTNPVATEQYGQCVCSNWEEDHNAENFNSDTQA

SEQ ID NO: 203904 - protein, 37 aa, Artificial Sequence
  Description of Artificial Sequence: Synthetic polypeptide
DAEEIATTNPVAYEQWGCNTAGNNGLNTTAEGGNLDE

SEQ ID NO: 203905 - protein, 35 aa, Artificial Sequence
  Description of Artificial Sequence: Synthetic polypeptide
DETEIRTTNPIATEMWGATTWANAEDIAEGFGPYI

SEQ ID NO: 203906 - protein, 35 aa, Artificial Sequence
  Description of Artificial Sequence: Synthetic polypeptide
DETEIRTTNPIATENWGATTWANAEDWAEPKGPYI

SEQ ID NO: 203907 - protein, 35 aa, Artificial Sequence
  Description of Artificial Sequence: Synthetic polypeptide
DETEIRTTNPIATENWGATTWANAEDWAGDKWPYI

SEQ ID NO: 203908 - protein, 35 aa, Artificial Sequence
  Description of Artificial Sequence: Synthetic polypeptide
DETEIRTTNPIATENWGATTWANAEDWGEPKGPYI

SEQ ID NO: 203909 - protein, 38 aa, Artificial Sequence
  Description of Artificial Sequence: Synthetic polypeptide
AEAEIRTTNPVATEQYGCYCSNWGEDHNAENFGSDTQS

SEQ ID NO: 203910 - protein, 36 aa, Artificial Sequence
  Description of Artificial Sequence: Synthetic polypeptide
DEAEISTTNPVAYEQYGCICSNWGEHNENFPSDTQA

SEQ ID NO: 203911 - protein, 35 aa, Artificial Sequence
  Description of Artificial Sequence: Synthetic polypeptide
DETEIRTTNPIATENWGATTWANAEGWAEPKGPYI

SEQ ID NO: 203912 - protein, 34 aa, Artificial Sequence
  Description of Artificial Sequence: Synthetic polypeptide
DDTEIATTNPIATEGWGATTWANADWQEPKGPYI

SEQ ID NO: 203913 - protein, 39 aa, Artificial Sequence
  Description of Artificial Sequence: Synthetic polypeptide
DDEEIRTTNPVAYEQYGQCVCSMWGEDHNAENFNSDTQA

SEQ ID NO: 203914 - protein, 35 aa, Artificial Sequence
  Description of Artificial Sequence: Synthetic polypeptide
DETEIRTTNPIATEMWGATTWANAEDWAEPKGPYI

SEQ ID NO: 203915 - protein, 37 aa, Artificial Sequence
  Description of Artificial Sequence: Synthetic polypeptide
SEYEISCTNPVATEQYGCVCENWGEHNAEHFGSDNQM

SEQ ID NO: 203916 - protein, 35 aa, Artificial Sequence
  Description of Artificial Sequence: Synthetic polypeptide
DETEIRTTNPIATEEWGATTWANAEDWAEPKGQYI

SEQ ID NO: 203917 - protein, 36 aa, Artificial Sequence
  Description of Artificial Sequence: Synthetic polypeptide
LNDEVATTNPVATEQYGSVFIVSAEDEWEGQMEDWQ

SEQ ID NO: 203918 - protein, 37 aa, Artificial Sequence
  Description of Artificial Sequence: Synthetic polypeptide
MEAEIATTNPVATEGYGCVCSNWGEDNAEGFNSDTQS

SEQ ID NO: 203919 - protein, 36 aa, Artificial Sequence
  Description of Artificial Sequence: Synthetic polypeptide
DETEIRTTNPIATECWGTATTWANAECWAEPKGPYI

SEQ ID NO: 203920 - protein, 36 aa, Artificial Sequence
  Description of Artificial Sequence: Synthetic polypeptide
DETEIRTTNPIATECWGTATTWANAEDEAEPKGPYI

SEQ ID NO: 203921 - protein, 36 aa, Artificial Sequence
  Description of Artificial Sequence: Synthetic polypeptide
DETEIRTTNPIATECWGTATTWANAEDWAEPKGPYI

SEQ ID NO: 203922 - protein, 39 aa, Artificial Sequence
  Description of Artificial Sequence: Synthetic polypeptide
DEEEIRTTNPVATEWYGQAWCTYNCDPGQDLEIIMDYQE

SEQ ID NO: 203923 - protein, 37 aa, Artificial Sequence
  Description of Artificial Sequence: Synthetic polypeptide
QEDEIRTTNPAATEQYGVVVVAGNNDGEDEGGEEQIQ

SEQ ID NO: 203924 - protein, 35 aa, Artificial Sequence
  Description of Artificial Sequence: Synthetic polypeptide
DETEIRTTNPIATECWGTTTWANADDPAEPKGPYI

SEQ ID NO: 203925 - protein, 35 aa, Artificial Sequence
  Description of Artificial Sequence: Synthetic polypeptide
DETEIRTTNPIATECWGTTTWANAEDDAEPKGPYI

SEQ ID NO: 203926 - protein, 35 aa, Artificial Sequence
  Description of Artificial Sequence: Synthetic polypeptide
DETEIRTTNPIATECWGTTTWANAEDWAEPKGPYI

SEQ ID NO: 203927 - protein, 37 aa, Artificial Sequence
  Description of Artificial Sequence: Synthetic polypeptide
QAEEIATTNPVAYEQYGSACSANPALGIDHPDDSAAK

SEQ ID NO: 203928 - protein, 38 aa, Artificial Sequence
  Description of Artificial Sequence: Synthetic polypeptide
MDNHIRTTNPVATEQYGSCVWYDAENDHETHGINQKKF

SEQ ID NO: 203929 - protein, 35 aa, Artificial Sequence
  Description of Artificial Sequence: Synthetic polypeptide
DETEIRTTNPIATECWGTTTWANATDGAEPKGPYG

SEQ ID NO: 203930 - protein, 38 aa, Artificial Sequence
  Description of Artificial Sequence: Synthetic polypeptide
DEECIRTTNPVAYEQYGQCVCSNWGEHNAENFISDTQS

SEQ ID NO: 203931 - protein, 39 aa, Artificial Sequence
  Description of Artificial Sequence: Synthetic polypeptide
DEECIRTTNPVAYEQYGQCVCSNWGEGHNQEYFNSDTQA

SEQ ID NO: 203932 - protein, 38 aa, Artificial Sequence
  Description of Artificial Sequence: Synthetic polypeptide
AEAEISTTNPVATEGYGCVTSTWGADDNAEYFNSDPQS

SEQ ID NO: 203933 - protein, 39 aa, Artificial Sequence
  Description of Artificial Sequence: Synthetic polypeptide
DEECIRTTNPVAYEQYGQCVCSNWGEDHNAENFNSENQM

SEQ ID NO: 203934 - protein, 35 aa, Artificial Sequence
  Description of Artificial Sequence: Synthetic polypeptide
DETEIRTTNPIATECWGTTTWANCEDWAEDKGPYI

SEQ ID NO: 203935 - protein, 39 aa, Artificial Sequence
  Description of Artificial Sequence: Synthetic polypeptide
DEEEIATTNPVATEQYGQCSCSNWGEPHNQENFISDTQS

SEQ ID NO: 203936 - protein, 39 aa, Artificial Sequence
  Description of Artificial Sequence: Synthetic polypeptide
DEECIRTTNPVAYEQYGQCVCSNWGEDHNAENFNSDTQL

SEQ ID NO: 203937 - protein, 37 aa, Artificial Sequence
  Description of Artificial Sequence: Synthetic polypeptide
DEQNEIATTNPVAYEAWGVVWPGPNNENDQGQGNGEV

SEQ ID NO: 203938 - protein, 37 aa, Artificial Sequence
  Description of Artificial Sequence: Synthetic polypeptide
DEECLRTTNPCAYEQYGCVCSNWGEHNIENFNSDTQS

SEQ ID NO: 203939 - protein, 35 aa, Artificial Sequence
  Description of Artificial Sequence: Synthetic polypeptide
DETEIRTTNPIATECWGRATWANAEDWHEPKGPYI

SEQ ID NO: 203940 - protein, 35 aa, Artificial Sequence
  Description of Artificial Sequence: Synthetic polypeptide
MEDEIRGTNCVATEAWGCVSAINGEGGDGEQEEQE

SEQ ID NO: 203941 - protein, 38 aa, Artificial Sequence
  Description of Artificial Sequence: Synthetic polypeptide
AEAEISTTNPVAYEQYGCVCSNWGEDHNTENFNSENQS

SEQ ID NO: 203942 - protein, 38 aa, Artificial Sequence
  Description of Artificial Sequence: Synthetic polypeptide
DEAEIATTNPVATCQYGCQVCSNWGAHNAENFNSDTQS

SEQ ID NO: 203943 - protein, 38 aa, Artificial Sequence
  Description of Artificial Sequence: Synthetic polypeptide
QEDEIRTTNPAATEQYGVVVVAGNNDGEQEGGEPEQEQ

SEQ ID NO: 203944 - protein, 37 aa, Artificial Sequence
  Description of Artificial Sequence: Synthetic polypeptide
QEDEIRTTNPAATEQYGVVVVAGNNDGEFEGGEEGDQ

SEQ ID NO: 203945 - protein, 38 aa, Artificial Sequence
  Description of Artificial Sequence: Synthetic polypeptide
DEAEISTTNPVAYEQYGCVCGNSGEDHNAENFNSDTQP

SEQ ID NO: 203946 - protein, 38 aa, Artificial Sequence
  Description of Artificial Sequence: Synthetic polypeptide
DEAEIATTNPVATAQWGANITTSATNHVLAGMPGGSHG

SEQ ID NO: 203947 - protein, 35 aa, Artificial Sequence
  Description of Artificial Sequence: Synthetic polypeptide
DETEIRTTNPIATECWGRTTWANAEDWAEPKGPYH

SEQ ID NO: 203948 - protein, 35 aa, Artificial Sequence
  Description of Artificial Sequence: Synthetic polypeptide
DETEIRTTNPIATECWGRTTWANAEDWAEPKGPYI

SEQ ID NO: 203949 - protein, 36 aa, Artificial Sequence
  Description of Artificial Sequence: Synthetic polypeptide
EEVEIRCTNPTAYEQWGSTVYGENDSDHQGGDGKTH

SEQ ID NO: 203950 - protein, 35 aa, Artificial Sequence
  Description of Artificial Sequence: Synthetic polypeptide
DDSEVASTNPVSTEGYGNVCYNTIDQSRHGQQEAH

SEQ ID NO: 203951 - protein, 37 aa, Artificial Sequence
  Description of Artificial Sequence: Synthetic polypeptide
QAEEIATTNPVAYEQYGSACAANPHLGNEHPMGEVAK

SEQ ID NO: 203952 - protein, 37 aa, Artificial Sequence
  Description of Artificial Sequence: Synthetic polypeptide
AEAEISTTNPVAYEQYGCVCSNWGEHNAENFNSDNQL

SEQ ID NO: 203953 - protein, 36 aa, Artificial Sequence
  Description of Artificial Sequence: Synthetic polypeptide
DETEIRTTNPIATECWGSTTWANAEDFWAEPKGPYI

SEQ ID NO: 203954 - protein, 38 aa, Artificial Sequence
  Description of Artificial Sequence: Synthetic polypeptide
DDECISTTNPVATEQYGQCVCSMWMEHNAENFNSDTQS

SEQ ID NO: 203955 - protein, 38 aa, Artificial Sequence
  Description of Artificial Sequence: Synthetic polypeptide
MEAEISTTNPVATEQYGCVCSVWGEDHNQEGFGSDTQM

SEQ ID NO: 203956 - protein, 37 aa, Artificial Sequence
  Description of Artificial Sequence: Synthetic polypeptide
MEAEIRGTNPVATEFYGSFGSNEGETGQGNDGEETDQ

SEQ ID NO: 203957 - protein, 35 aa, Artificial Sequence
  Description of Artificial Sequence: Synthetic polypeptide
DETEIRTTNPIATECWGTTTWRNAEDWAEPKGPYI

SEQ ID NO: 203958 - protein, 38 aa, Artificial Sequence
  Description of Artificial Sequence: Synthetic polypeptide
AEAEISTTNPVATEGYGCVCSNWGEDHNTENFNSDNQA

SEQ ID NO: 203959 - protein, 39 aa, Artificial Sequence
  Description of Artificial Sequence: Synthetic polypeptide
DEECIRTTNPVAYEQYGQCVCSNWGEDHNAENFNSDNQS

SEQ ID NO: 203960 - protein, 36 aa, Artificial Sequence
  Description of Artificial Sequence: Synthetic polypeptide
DETEIRTTNPIATECWGWATTWANAEDWAEPKGYYI

SEQ ID NO: 203961 - protein, 35 aa, Artificial Sequence
  Description of Artificial Sequence: Synthetic polypeptide
DETEIRTTNPIATECWGWTIWANAEDWAEPKGPYI

SEQ ID NO: 203962 - protein, 35 aa, Artificial Sequence
  Description of Artificial Sequence: Synthetic polypeptide
DETEIRTTNPIATECWGWTTWANAEDWAEPKGPYI

SEQ ID NO: 203963 - protein, 38 aa, Artificial Sequence
  Description of Artificial Sequence: Synthetic polypeptide
CEEEISTTNPVATEQYGCVCSNWGEDHNAENFISDTQA

SEQ ID NO: 203964 - protein, 36 aa, Artificial Sequence
  Description of Artificial Sequence: Synthetic polypeptide
DETEIRTTNPIATECWGYATTWANAEDWAEKKGPYI

SEQ ID NO: 203965 - protein, 36 aa, Artificial Sequence
  Description of Artificial Sequence: Synthetic polypeptide
DETEIRTTNPIATECWGYATTWANAEDWAEPKGPYI

SEQ ID NO: 203966 - protein, 36 aa, Artificial Sequence
  Description of Artificial Sequence: Synthetic polypeptide
DETEIRTTNPIATECWGYATTWANAEDWWEPKGPYI

SEQ ID NO: 203967 - protein, 36 aa, Artificial Sequence
  Description of Artificial Sequence: Synthetic polypeptide
DETEIRTTNPIATECWGYATTWANAEMWAEPKGPYI

SEQ ID NO: 203968 - protein, 35 aa, Artificial Sequence
  Description of Artificial Sequence: Synthetic polypeptide
DETEIRTTNPIATECWGYTTWANAEDWAEPKGPYI

SEQ ID NO: 203969 - protein, 35 aa, Artificial Sequence
  Description of Artificial Sequence: Synthetic polypeptide
DETEIRTTNPIATECWGYTTWANAEDWAEPKGTYI

SEQ ID NO: 203970 - protein, 37 aa, Artificial Sequence
  Description of Artificial Sequence: Synthetic polypeptide
MDMEIGCTNPVATEQYGSVAYMVLDNSSEEEGNENID

SEQ ID NO: 203971 - protein, 36 aa, Artificial Sequence
  Description of Artificial Sequence: Synthetic polypeptide
MDMEIGCTNPVATEQYGSVANVLDMNSSEEEKNENI

SEQ ID NO: 203972 - protein, 40 aa, Artificial Sequence
  Description of Artificial Sequence: Synthetic polypeptide
DEEEIRTTNPVATEAYGNVVVTVTTNQAGTEAGTVTQEEE

SEQ ID NO: 203973 - protein, 38 aa, Artificial Sequence
  Description of Artificial Sequence: Synthetic polypeptide
LWPEIRTTNPVATEQYGNITLSEAPNQEVVWTHVGGND

SEQ ID NO: 203974 - protein, 36 aa, Artificial Sequence
  Description of Artificial Sequence: Synthetic polypeptide
DAAEIATTNPVAYEQWGTTSAGTGPAGNPHGMEGMK

SEQ ID NO: 203975 - protein, 36 aa, Artificial Sequence
  Description of Artificial Sequence: Synthetic polypeptide
SQEEIRTTNPVATEHWGVTMYSSEWNETEFPINVKT

SEQ ID NO: 203976 - protein, 37 aa, Artificial Sequence
  Description of Artificial Sequence: Synthetic polypeptide
QAEEIATTNPVAYEQYGSTVCAGNGGDGATAGEGVDD

SEQ ID NO: 203977 - protein, 36 aa, Artificial Sequence
  Description of Artificial Sequence: Synthetic polypeptide
DETEIRTTNPIATECWGWATTWANAEDWAEPKGPYI

SEQ ID NO: 203978 - protein, 36 aa, Artificial Sequence
  Description of Artificial Sequence: Synthetic polypeptide
DETEIRTTNPIATECWGWATTWANAEDVAEPKGPYI

SEQ ID NO: 203979 - protein, 38 aa, Artificial Sequence
  Description of Artificial Sequence: Synthetic polypeptide
CEEEISTTNPVATEQYGCVCSNWGEDHNAENFMSETQS

SEQ ID NO: 203980 - protein, 36 aa, Artificial Sequence
  Description of Artificial Sequence: Synthetic polypeptide
DETEIRTTNPIATECWGVTTWANATDGPAEPKGPYN

SEQ ID NO: 203981 - protein, 39 aa, Artificial Sequence
  Description of Artificial Sequence: Synthetic polypeptide
DEECIRTTNPVAYEQYGQCVCSNWGEDDNQEYFNSDNQS

SEQ ID NO: 203982 - protein, 38 aa, Artificial Sequence
  Description of Artificial Sequence: Synthetic polypeptide
DEECIRTTNPVAYEQYGQCVCSNWGEDDNANFNSDTQS

SEQ ID NO: 203983 - protein, 39 aa, Artificial Sequence
  Description of Artificial Sequence: Synthetic polypeptide
DESEIATTNPVATEQYGDVVIMTQGGPEGMLIFNDNGLE

SEQ ID NO: 203984 - protein, 39 aa, Artificial Sequence
  Description of Artificial Sequence: Synthetic polypeptide
DEECIRTTNPVAYEQYGQCVCSNWGEAHNDENFNSDTQS

SEQ ID NO: 203985 - protein, 39 aa, Artificial Sequence
  Description of Artificial Sequence: Synthetic polypeptide
DEECIRTTNPVAYEQYGQCVCSNWEEDHNAENFNSDTQA

SEQ ID NO: 203986 - protein, 39 aa, Artificial Sequence
  Description of Artificial Sequence: Synthetic polypeptide
DEECIRTTNPVAYEQYGQCQVCSNWGEHNQEYFGSDTQA

SEQ ID NO: 203987 - protein, 38 aa, Artificial Sequence
  Description of Artificial Sequence: Synthetic polypeptide
DDECISTTNPVATEQYGQCVCSMWGEHNAEFFNSDTQS

SEQ ID NO: 203988 - protein, 36 aa, Artificial Sequence
  Description of Artificial Sequence: Synthetic polypeptide
DETEIRTTNPIATECWGTWTTWANAEDWAEPKGPYI

SEQ ID NO: 203989 - protein, 35 aa, Artificial Sequence
  Description of Artificial Sequence: Synthetic polypeptide
DETEIRTTNPIATEEWGATTWANAEDWAEPKGPYI

SEQ ID NO: 203990 - protein, 36 aa, Artificial Sequence
  Description of Artificial Sequence: Synthetic polypeptide
DETEIRTTNPIATECWGVATGWANAADWAEPKGTYY

SEQ ID NO: 203991 - protein, 36 aa, Artificial Sequence
  Description of Artificial Sequence: Synthetic polypeptide
DETEIRTTNPIATECWGVATTWANAEDWAEPKGPYI

SEQ ID NO: 203992 - protein, 38 aa, Artificial Sequence
  Description of Artificial Sequence: Synthetic polypeptide
AEAEISTTNPVATEEYGCSCSNWGEDDNAENFGSDNQA

SEQ ID NO: 203993 - protein, 36 aa, Artificial Sequence
  Description of Artificial Sequence: Synthetic polypeptide
DETEIRTTNPIATECWGVATTWANAKDWAEPKGPYI

SEQ ID NO: 203994 - protein, 36 aa, Artificial Sequence
  Description of Artificial Sequence: Synthetic polypeptide
DETEIRTTNPIATECWGVAWTSANAEDWAEPKGPYI

SEQ ID NO: 203995 - protein, 38 aa, Artificial Sequence
  Description of Artificial Sequence: Synthetic polypeptide
DEEEIATTNPVATEMWGHVVANAGPAVGTEHQDDNLAK

SEQ ID NO: 203996 - protein, 36 aa, Artificial Sequence
  Description of Artificial Sequence: Synthetic polypeptide
DETEIRTTNPIATECWGVTTPANATDWMIEPKGPYP

SEQ ID NO: 203997 - protein, 36 aa, Artificial Sequence
  Description of Artificial Sequence: Synthetic polypeptide
DETEIRTTNPIATECWGVTTTPANATDWAGPKGPYE

SEQ ID NO: 203998 - protein, 36 aa, Artificial Sequence
  Description of Artificial Sequence: Synthetic polypeptide
DETEIRTTNPIATECWGVTTWANAADWAEPKGTPYY

SEQ ID NO: 203999 - protein, 36 aa, Artificial Sequence
  Description of Artificial Sequence: Synthetic polypeptide
DETEIRTTNPIATECWGVATHWANAEDWAEPKGPYI

SEQ ID NO: 204000 - protein, 36 aa, Artificial Sequence
  Description of Artificial Sequence: Synthetic polypeptide
DETEIRTTNPIATECWGRATTWANAEDWAEPKGPYI

SEQ ID NO: 204001 - protein, 39 aa, Artificial Sequence
  Description of Artificial Sequence: Synthetic polypeptide
DDEEIRTTNPVAYEQYGQCVCSNWGEDHNAEFFNSDTQS

SEQ ID NO: 204002 - protein, 36 aa, Artificial Sequence
  Description of Artificial Sequence: Synthetic polypeptide
DETEIRTTNPIATEQWGATTWANAEDWPAMPKGPPV

SEQ ID NO: 204003 - protein, 39 aa, Artificial Sequence
  Description of Artificial Sequence: Synthetic polypeptide
AEEEISTTNPVAYEQYGQCVCSNWGEDTNAENFNSDTQF

SEQ ID NO: 204004 - protein, 38 aa, Artificial Sequence
  Description of Artificial Sequence: Synthetic polypeptide
SETAEIACTNPVAYEQWGSVAITNTLPEAPGNQNPLQQ

SEQ ID NO: 204005 - protein, 38 aa, Artificial Sequence
  Description of Artificial Sequence: Synthetic polypeptide
SETAEIACTNPVAYEQWGSVAITNPLPTAPGNQNPTQQ

SEQ ID NO: 204006 - protein, 38 aa, Artificial Sequence
  Description of Artificial Sequence: Synthetic polypeptide
SETAEIACTNPVAYEQWGSVAITNPLPEAPGNQNPPLQ

SEQ ID NO: 204007 - protein, 38 aa, Artificial Sequence
  Description of Artificial Sequence: Synthetic polypeptide
SETAEIACTNPVAYEQWGSVAITNPLPEAPGNQNPEQW

SEQ ID NO: 204008 - protein, 38 aa, Artificial Sequence
  Description of Artificial Sequence: Synthetic polypeptide
SETAEIACTNPVAYEQWGSVAITNPLPEAPGNQMPKQQ

SEQ ID NO: 204009 - protein, 37 aa, Artificial Sequence
  Description of Artificial Sequence: Synthetic polypeptide
SETAEIACTNPVAYEQWGSVAITNPLPEAPDNQNPQM

SEQ ID NO: 204010 - protein, 36 aa, Artificial Sequence
  Description of Artificial Sequence: Synthetic polypeptide
SETAEIACTNPVAYEQWGSVAITNHDEATGDGDEHD

SEQ ID NO: 204011 - protein, 38 aa, Artificial Sequence
  Description of Artificial Sequence: Synthetic polypeptide
AEEEISTTNPVAYEQYGQCVCSNWGEHNAENFGSETQA

SEQ ID NO: 204012 - protein, 38 aa, Artificial Sequence
  Description of Artificial Sequence: Synthetic polypeptide
SEAEIRTTNPVAYEQYGCVCSNWGEDHNAENFNSDFQA

SEQ ID NO: 204013 - protein, 38 aa, Artificial Sequence
  Description of Artificial Sequence: Synthetic polypeptide
AEEEISTTNPVAYEQYGQCVCSNWGEHNAENFNSDTQA

SEQ ID NO: 204014 - protein, 38 aa, Artificial Sequence
  Description of Artificial Sequence: Synthetic polypeptide
AEEEISTTNPVAYEQYGQCVCSNWGEHNAENFNSDTQP

SEQ ID NO: 204015 - protein, 37 aa, Artificial Sequence
  Description of Artificial Sequence: Synthetic polypeptide
DESEASAATNPVAYEQWGTVCATADPLGQPHQEGENH

SEQ ID NO: 204016 - protein, 36 aa, Artificial Sequence
  Description of Artificial Sequence: Synthetic polypeptide
DEAEIASTNPVAYEAWGSVVCGNAQLDHVDSSNDHQ

SEQ ID NO: 204017 - protein, 38 aa, Artificial Sequence
  Description of Artificial Sequence: Synthetic polypeptide
AEEEISTTNPVAYEQYGQCVCSNWGEHNAENFNSDTQS

SEQ ID NO: 204018 - protein, 36 aa, Artificial Sequence
  Description of Artificial Sequence: Synthetic polypeptide
DEAEIASTNPVAYEAWGSVVCGNAQLDHVDQDNDHK

SEQ ID NO: 204019 - protein, 36 aa, Artificial Sequence
  Description of Artificial Sequence: Synthetic polypeptide
DETEIRTTNPTATECWGATTWANAEDLWAEPKGPYI

SEQ ID NO: 204020 - protein, 39 aa, Artificial Sequence
  Description of Artificial Sequence: Synthetic polypeptide
AEEEISTTNPVAYEQYGQCVCSNWGEDHNQEGSNSDTQA

SEQ ID NO: 204021 - protein, 35 aa, Artificial Sequence
  Description of Artificial Sequence: Synthetic polypeptide
DETEIRTTNPTATECWGATTWANAEDWAEPKGPYI

SEQ ID NO: 204022 - protein, 34 aa, Artificial Sequence
  Description of Artificial Sequence: Synthetic polypeptide
DAAEIATTNPVAYEQWGAFACAANNPVDDDGGTA

SEQ ID NO: 204023 - protein, 35 aa, Artificial Sequence
  Description of Artificial Sequence: Synthetic polypeptide
DETEIRTTNPISTEPWGTTIANMEDIQAQPKGPYI

SEQ ID NO: 204024 - protein, 34 aa, Artificial Sequence
  Description of Artificial Sequence: Synthetic polypeptide
DETEIRTTNPISTECWGATVWAAEDWAEPKGPYI

SEQ ID NO: 204025 - protein, 34 aa, Artificial Sequence
  Description of Artificial Sequence: Synthetic polypeptide
DETEIRTTNPISTEPWGATTANAEDIAEPKGPYI

SEQ ID NO: 204026 - protein, 35 aa, Artificial Sequence
  Description of Artificial Sequence: Synthetic polypeptide
DETEIRTTNPISTEPWGATTANAEDIQAEPKGPYH

SEQ ID NO: 204027 - protein, 37 aa, Artificial Sequence
  Description of Artificial Sequence: Synthetic polypeptide
DEACIRTTNPLATEQFGCVCSWGEDHNQESFNSDTQA

SEQ ID NO: 204028 - protein, 34 aa, Artificial Sequence
  Description of Artificial Sequence: Synthetic polypeptide
DETEIRTTNPISTEPWGATTWANAEDIAEPKGPI

SEQ ID NO: 204029 - protein, 38 aa, Artificial Sequence
  Description of Artificial Sequence: Synthetic polypeptide
DEEEIRCTNPVSTEQYGQCVCGNWGEHNAEGFISQTQA

SEQ ID NO: 204030 - protein, 39 aa, Artificial Sequence
  Description of Artificial Sequence: Synthetic polypeptide
ADEEIRTTNPVATEQYGQCVCSNWGEDHNAENFNSDNQA

SEQ ID NO: 204031 - protein, 37 aa, Artificial Sequence
  Description of Artificial Sequence: Synthetic polypeptide
SEAEISCTNPCATEQYGCVCSNWGEDNAEHFGSDNQS

SEQ ID NO: 204032 - protein, 34 aa, Artificial Sequence
  Description of Artificial Sequence: Synthetic polypeptide
DETEIRTTNPISTEPWGATTWANAEDWAEPKGPI

SEQ ID NO: 204033 - protein, 36 aa, Artificial Sequence
  Description of Artificial Sequence: Synthetic polypeptide
DETEIRTTNPISTEPWGATTWANMEDIQAEPNGNYI

SEQ ID NO: 204034 - protein, 36 aa, Artificial Sequence
  Description of Artificial Sequence: Synthetic polypeptide
DETEIRTTNPISTEPWGATTWANMEDIQQEPNGNYI

SEQ ID NO: 204035 - protein, 39 aa, Artificial Sequence
  Description of Artificial Sequence: Synthetic polypeptide
DEEEIRGTNPVATDFYGSVIVQDMDQDENADDEGGSNNT

SEQ ID NO: 204036 - protein, 38 aa, Artificial Sequence
  Description of Artificial Sequence: Synthetic polypeptide
DEACIRTTNPLATEQWGCVCSNWGEDDNQESFGSDNQA

SEQ ID NO: 204037 - protein, 36 aa, Artificial Sequence
  Description of Artificial Sequence: Synthetic polypeptide
DETEIRTTNPISTEPWGATTWANMEDIQQQPNGNYI

SEQ ID NO: 204038 - protein, 35 aa, Artificial Sequence
  Description of Artificial Sequence: Synthetic polypeptide
DETEIRTTNPISTEPWGATWANAEDIQAEQNGPYI

SEQ ID NO: 204039 - protein, 39 aa, Artificial Sequence
  Description of Artificial Sequence: Synthetic polypeptide
DEEEIRGTNPVATDQYGAVVSVVDDGEMVQGQGDGTAEG

SEQ ID NO: 204040 - protein, 33 aa, Artificial Sequence
  Description of Artificial Sequence: Synthetic polypeptide
SETEIACTNPCSYEQWGITCYCNDQQDHGDAVR

SEQ ID NO: 204041 - protein, 35 aa, Artificial Sequence
  Description of Artificial Sequence: Synthetic polypeptide
DETEIRTTNPISTEPWGTTISNMEDIQAQQNGPYI

SEQ ID NO: 204042 - protein, 38 aa, Artificial Sequence
  Description of Artificial Sequence: Synthetic polypeptide
SESEIVRTTLNPMAYERYGTVVASCTNMVAQLTGGTQY

SEQ ID NO: 204043 - protein, 38 aa, Artificial Sequence
  Description of Artificial Sequence: Synthetic polypeptide
AEEEISTTNPVAYEQYGQCVCSNWGEHNAEYFNSDNQS

SEQ ID NO: 204044 - protein, 36 aa, Artificial Sequence
  Description of Artificial Sequence: Synthetic polypeptide
DETEIRTTNPTATECWGATTWTNAEDWEEPQEPQIE

SEQ ID NO: 204045 - protein, 40 aa, Artificial Sequence
  Description of Artificial Sequence: Synthetic polypeptide
DEEEISTTNPVATEQYGQCIVCSNWGEDDNAENFNSENQA

SEQ ID NO: 204046 - protein, 40 aa, Artificial Sequence
  Description of Artificial Sequence: Synthetic polypeptide
DEEEISTTNPVATEQYGQCIVCSNWGEDHNQENFNSDTQA

SEQ ID NO: 204047 - protein, 34 aa, Artificial Sequence
  Description of Artificial Sequence: Synthetic polypeptide
KEDEIRCTNPTAYECWGCVYYENDDRHRSDDERR

SEQ ID NO: 204048 - protein, 38 aa, Artificial Sequence
  Description of Artificial Sequence: Synthetic polypeptide
DDEEISCTNPVATEQYGCVCSNWGEDHNIENSGSQTQA

SEQ ID NO: 204049 - protein, 40 aa, Artificial Sequence
  Description of Artificial Sequence: Synthetic polypeptide
DEEEISTTNPVATEQYGQCQVCSDWGYDHNAENFNSENQS

SEQ ID NO: 204050 - protein, 37 aa, Artificial Sequence
  Description of Artificial Sequence: Synthetic polypeptide
QEDEIRTTNPAATEQYGVVVVAGNNDGEDEEGEGQDQ

SEQ ID NO: 204051 - protein, 40 aa, Artificial Sequence
  Description of Artificial Sequence: Synthetic polypeptide
DEEEISTTNPVATEQYGQCQVCSNSGELHNAENFNSDTQL

SEQ ID NO: 204052 - protein, 40 aa, Artificial Sequence
  Description of Artificial Sequence: Synthetic polypeptide
DEEEISTTNPVATEQYGQCQVCSNWEEDHNAENFNSETQS

SEQ ID NO: 204053 - protein, 40 aa, Artificial Sequence
  Description of Artificial Sequence: Synthetic polypeptide
DEEEISTTNPVATEQYGQCQVCSNWGEDDNAENFNSDNQS

SEQ ID NO: 204054 - protein, 38 aa, Artificial Sequence
  Description of Artificial Sequence: Synthetic polypeptide
QEDEIRTTNPAATEQYGVVVVADNNDGNQEGGEGEQDQ

SEQ ID NO: 204055 - protein, 37 aa, Artificial Sequence
  Description of Artificial Sequence: Synthetic polypeptide
EESEIRTTNPVAYECWGTVCPTDNMGVVNGQKGDDQK

SEQ ID NO: 204056 - protein, 40 aa, Artificial Sequence
  Description of Artificial Sequence: Synthetic polypeptide
DEEEISTTNPVATEQYGQCQVCSNWGEDHNAEHFNSDTQS

SEQ ID NO: 204057 - protein, 40 aa, Artificial Sequence
  Description of Artificial Sequence: Synthetic polypeptide
DEEEISTTNPVATEQYGQCQVCSNWGEDHNAENFNSDNQA

SEQ ID NO: 204058 - protein, 40 aa, Artificial Sequence
  Description of Artificial Sequence: Synthetic polypeptide
DEEEISTTNPVATEQYGQCQVCSNWGEDHNAENFNSDTQS

SEQ ID NO: 204059 - protein, 40 aa, Artificial Sequence
  Description of Artificial Sequence: Synthetic polypeptide
DEEEISTTNPVATEQYGQCQVCSNWGEDHNAENFNSETQM

SEQ ID NO: 204060 - protein, 34 aa, Artificial Sequence
  Description of Artificial Sequence: Synthetic polypeptide
KEDEIRCTNPTAYECWGCVYYENDDRHRGDDEAQ

SEQ ID NO: 204061 - protein, 40 aa, Artificial Sequence
  Description of Artificial Sequence: Synthetic polypeptide
DEEEISTTNPVATEQYGQCQVCSNWGEDHNQENFGSDTQA

SEQ ID NO: 204062 - protein, 38 aa, Artificial Sequence
  Description of Artificial Sequence: Synthetic polypeptide
DDEEISCTNPVATEQYGCVCSNWGEDHNAENFNSETQA

SEQ ID NO: 204063 - protein, 40 aa, Artificial Sequence
  Description of Artificial Sequence: Synthetic polypeptide
DEEEISTTNPVATEQYGQCAVCSNWGEAHNAENFNSDTQS

SEQ ID NO: 204064 - protein, 38 aa, Artificial Sequence
  Description of Artificial Sequence: Synthetic polypeptide
AEEEISTTNPVAYEQYGQCVCSWGEDHNAENFNSDTQS

SEQ ID NO: 204065 - protein, 37 aa, Artificial Sequence
  Description of Artificial Sequence: Synthetic polypeptide
QAEEIATTNPVAYEQYGSVPAIANNDDQPDSKAIEDD

SEQ ID NO: 204066 - protein, 37 aa, Artificial Sequence
  Description of Artificial Sequence: Synthetic polypeptide
SESEIRTTNPVAYEQWGTCCPTDNHGMVNGQKGSDIP

SEQ ID NO: 204067 - protein, 38 aa, Artificial Sequence
  Description of Artificial Sequence: Synthetic polypeptide
DDSEIRTTNPVATEGWGQCVCSTWGEENAEYFGSDTQS

SEQ ID NO: 204068 - protein, 35 aa, Artificial Sequence
  Description of Artificial Sequence: Synthetic polypeptide
DETEIRTTNPTATEKWGATTWANAEDWAEPKGPYI

SEQ ID NO: 204069 - protein, 36 aa, Artificial Sequence
  Description of Artificial Sequence: Synthetic polypeptide
DAAEIATTNPVAYEPQWGTTACAGMPAGNPQGNEQR

SEQ ID NO: 204070 - protein, 34 aa, Artificial Sequence
  Description of Artificial Sequence: Synthetic polypeptide
KESEICCTNPTAYECWGCVYGENDDMHRQGDDRR

SEQ ID NO: 204071 - protein, 39 aa, Artificial Sequence
  Description of Artificial Sequence: Synthetic polypeptide
DEACIRTTNPVATEGYGQCVTSTWGADDNAEYFNSDPQS

SEQ ID NO: 204072 - protein, 38 aa, Artificial Sequence
  Description of Artificial Sequence: Synthetic polypeptide
SESEIRTTNPVATEQYGCYNSETFPHWEEFREEEIHED

SEQ ID NO: 204073 - protein, 38 aa, Artificial Sequence
  Description of Artificial Sequence: Synthetic polypeptide
SEAEIRTTNPVATEWYGQAWYTYNTDPGMDSEINDYQE

SEQ ID NO: 204074 - protein, 39 aa, Artificial Sequence
  Description of Artificial Sequence: Synthetic polypeptide
AEEEISTTNPVAYEQYGQCVCSNWGEDDNQEYFGSDNQA

SEQ ID NO: 204075 - protein, 39 aa, Artificial Sequence
  Description of Artificial Sequence: Synthetic polypeptide
AEEEISTTNPVAYEQYGQCVCSNWGELHNAEGFNSDNQS

SEQ ID NO: 204076 - protein, 38 aa, Artificial Sequence
  Description of Artificial Sequence: Synthetic polypeptide
AEEEISTTNPVAYEQYGQCVCSWGEDDNAENFNSETQA

SEQ ID NO: 204077 - protein, 38 aa, Artificial Sequence
  Description of Artificial Sequence: Synthetic polypeptide
SESEIRTTNPVATEQWGCYNSETIPGLEEFGEEEGHED

SEQ ID NO: 204078 - protein, 37 aa, Artificial Sequence
  Description of Artificial Sequence: Synthetic polypeptide
SESEIRTTNPVATEQWGCYNSEFIPLEEFGEEEMHED

SEQ ID NO: 204079 - protein, 37 aa, Artificial Sequence
  Description of Artificial Sequence: Synthetic polypeptide
DEECISTVNPVATEGYGCVCSNWGEHNIEYFNSDTQS

SEQ ID NO: 204080 - protein, 37 aa, Artificial Sequence
  Description of Artificial Sequence: Synthetic polypeptide
DEECISTTNPVCTEHYGCVCSNWGEHNAENFNSDTQS

SEQ ID NO: 204081 - protein, 39 aa, Artificial Sequence
  Description of Artificial Sequence: Synthetic polypeptide
DEEEIRTTNPVAYEQWGQCVCSNWGEDHNQEFFNSDNQS

SEQ ID NO: 204082 - protein, 36 aa, Artificial Sequence
  Description of Artificial Sequence: Synthetic polypeptide
SESEIRTTNPCSYEQWGSCYTIDNHRQNGGGKTGTG

SEQ ID NO: 204083 - protein, 39 aa, Artificial Sequence
  Description of Artificial Sequence: Synthetic polypeptide
DEECISTTNPVAYEQYGQCVTSTWGADDNAEYFNSDPQS

SEQ ID NO: 204084 - protein, 37 aa, Artificial Sequence
  Description of Artificial Sequence: Synthetic polypeptide
SESEIRTTNPVATEQWGMYNPETIPLEEFGEEEIHED

SEQ ID NO: 204085 - protein, 39 aa, Artificial Sequence
  Description of Artificial Sequence: Synthetic polypeptide
DDEEIRTTNPVAYEQYGQCVCSNWGEDHNAENFNSDTQA

SEQ ID NO: 204086 - protein, 35 aa, Artificial Sequence
  Description of Artificial Sequence: Synthetic polypeptide
DETEIRTTNPISTECWGATTWSNMEDWQQPKGPYI

SEQ ID NO: 204087 - protein, 35 aa, Artificial Sequence
  Description of Artificial Sequence: Synthetic polypeptide
DETEIRTTNPISTECWGATTWSNMEDWAEPKGNYI

SEQ ID NO: 204088 - protein, 35 aa, Artificial Sequence
  Description of Artificial Sequence: Synthetic polypeptide
DETEIRTTNPIATERWGATTWANAEDWAEPKGPYI

SEQ ID NO: 204089 - protein, 38 aa, Artificial Sequence
  Description of Artificial Sequence: Synthetic polypeptide
DDEEIRTTNPVGTEGWGCVCSNWGEDHNAENFGSDNQS

SEQ ID NO: 204090 - protein, 38 aa, Artificial Sequence
  Description of Artificial Sequence: Synthetic polypeptide
DDECISTTNPVATEQYGCVCSNWGEDHNAENFNSDTQQ

SEQ ID NO: 204091 - protein, 38 aa, Artificial Sequence
  Description of Artificial Sequence: Synthetic polypeptide
DDEEIRTTNPVGTEQWGCVCSNWGEDDNAENFNSDNQS

SEQ ID NO: 204092 - protein, 38 aa, Artificial Sequence
  Description of Artificial Sequence: Synthetic polypeptide
DDECISTTNPVATEQYGCVCSNWGEDHNAENFNSDTQF

SEQ ID NO: 204093 - protein, 38 aa, Artificial Sequence
  Description of Artificial Sequence: Synthetic polypeptide
AEEEISTTNPVAYEQYGCVCSNWGEDHNAEGFNSETQA

SEQ ID NO: 204094 - protein, 38 aa, Artificial Sequence
  Description of Artificial Sequence: Synthetic polypeptide
DDECISTTNPVATEQYGCVCSNWGEDHNAENFNSDTQA

SEQ ID NO: 204095 - protein, 35 aa, Artificial Sequence
  Description of Artificial Sequence: Synthetic polypeptide
DETEIRTTNPIATESWGATTWANAEDWAEPKGPYI

SEQ ID NO: 204096 - protein, 38 aa, Artificial Sequence
  Description of Artificial Sequence: Synthetic polypeptide
AEEEISTTNPVAYEQYGCVCSNWGEDHNAENFNSDTQA

SEQ ID NO: 204097 - protein, 38 aa, Artificial Sequence
  Description of Artificial Sequence: Synthetic polypeptide
AEEEISTTNPVAYEQYGCVCSNWGEDHNAENFNSETQA

SEQ ID NO: 204098 - protein, 37 aa, Artificial Sequence
  Description of Artificial Sequence: Synthetic polypeptide
SEYEIRCTNPVATEQYGCVCEMWGEHNQEHFNSDTQS

SEQ ID NO: 204099 - protein, 36 aa, Artificial Sequence
  Description of Artificial Sequence: Synthetic polypeptide
CEEEIATTNPVAYEPWGHSACAAANGDAMQGGDQAQ

SEQ ID NO: 204100 - protein, 35 aa, Artificial Sequence
  Description of Artificial Sequence: Synthetic polypeptide
DETEIRTTNPIATESWGATTWANAEDWWEPKGPYI

SEQ ID NO: 204101 - protein, 35 aa, Artificial Sequence
  Description of Artificial Sequence: Synthetic polypeptide
DETEIRTTNPIATESWGATTWSNAEDWAEMKGPYI

SEQ ID NO: 204102 - protein, 35 aa, Artificial Sequence
  Description of Artificial Sequence: Synthetic polypeptide
DETEIRTTNPIATETWGATTWANAEDWAEPKGPYI

SEQ ID NO: 204103 - protein, 35 aa, Artificial Sequence
  Description of Artificial Sequence: Synthetic polypeptide
DETEIRTTNPIATEVWGATTWANAEDWAEPKGPYI

SEQ ID NO: 204104 - protein, 35 aa, Artificial Sequence
  Description of Artificial Sequence: Synthetic polypeptide
DETEIRTTNPIATEWWGATTWANAEAWAEPKGPYI

SEQ ID NO: 204105 - protein, 36 aa, Artificial Sequence
  Description of Artificial Sequence: Synthetic polypeptide
DETEIRTTNPIATERWGATTWANAEDWAEPKGNPYI

SEQ ID NO: 204106 - protein, 35 aa, Artificial Sequence
  Description of Artificial Sequence: Synthetic polypeptide
DETEIRTTNPIATEWWGATTWANAEDWAEPKGPYI

SEQ ID NO: 204107 - protein, 37 aa, Artificial Sequence
  Description of Artificial Sequence: Synthetic polypeptide
DAAEIATTNPVAYEQWGCNVVTNGNNIEAPTNQNGAD

SEQ ID NO: 204108 - protein, 38 aa, Artificial Sequence
  Description of Artificial Sequence: Synthetic polypeptide
DDECISTTNPVATEQYGCVCSNWGEDHNAENFNSDTQS

SEQ ID NO: 204109 - protein, 35 aa, Artificial Sequence
  Description of Artificial Sequence: Synthetic polypeptide
DEATIGTTNPVATEQYGCLCTATDGWPVEFETDKQ

SEQ ID NO: 204110 - protein, 39 aa, Artificial Sequence
  Description of Artificial Sequence: Synthetic polypeptide
DDEEIRTTNPVAYEQYGQCVCSNWGEDHNAENFNSETQP

SEQ ID NO: 204111 - protein, 39 aa, Artificial Sequence
  Description of Artificial Sequence: Synthetic polypeptide
DDEEIRTTNPVAYEQYGQCVCSNWGEDHNAENSNSDNQS

SEQ ID NO: 204112 - protein, 39 aa, Artificial Sequence
  Description of Artificial Sequence: Synthetic polypeptide
DDEEIRTTNPVAYEQYGQCVCSNWGEDHNAENSNSETQS

SEQ ID NO: 204113 - protein, 39 aa, Artificial Sequence
  Description of Artificial Sequence: Synthetic polypeptide
DDEEIRTTNPVAYEQYGQCVCSNWGEDHNAESFNSDTQS

SEQ ID NO: 204114 - protein, 38 aa, Artificial Sequence
  Description of Artificial Sequence: Synthetic polypeptide
DDECISTTNPVATEQYGCVCSNWGEDHNQENFGSETQS

SEQ ID NO: 204115 - protein, 39 aa, Artificial Sequence
  Description of Artificial Sequence: Synthetic polypeptide
DDEEIRTTNPVAYEQYGQCVCSNWGEDHNIEHFNSDFQS

SEQ ID NO: 204116 - protein, 38 aa, Artificial Sequence
  Description of Artificial Sequence: Synthetic polypeptide
AEEEISTTNPVAYEQYGCVCSMWGEDHNAENFNSDNQS

SEQ ID NO: 204117 - protein, 39 aa, Artificial Sequence
  Description of Artificial Sequence: Synthetic polypeptide
DDEEIRTTNPVAYEQYGQCVCSNWGEDHNTEHFNSDTQS

SEQ ID NO: 204118 - protein, 38 aa, Artificial Sequence
  Description of Artificial Sequence: Synthetic polypeptide
DEECISTVNPVATEQYGQCVCSNWGEDNAENFNSQTQS

SEQ ID NO: 204119 - protein, 38 aa, Artificial Sequence
  Description of Artificial Sequence: Synthetic polypeptide
AEEEISTTNPVAYEQYGCVCSNWEEDHNQENFPSDNQL

SEQ ID NO: 204120 - protein, 38 aa, Artificial Sequence
  Description of Artificial Sequence: Synthetic polypeptide
DDEEIRTTNPVAYEQYGQCVCSNWGEHNEENFISDTQA

SEQ ID NO: 204121 - protein, 38 aa, Artificial Sequence
  Description of Artificial Sequence: Synthetic polypeptide
AEEEISTTNPVAYEQYGCVCSNWGEDHNAEFFNSDTQS

SEQ ID NO: 204122 - protein, 37 aa, Artificial Sequence
  Description of Artificial Sequence: Synthetic polypeptide
DEECISTVNPVATEGYGQCVCSWGEHNEEYFISDNQS

SEQ ID NO: 204123 - protein, 38 aa, Artificial Sequence
  Description of Artificial Sequence: Synthetic polypeptide
DDECISTTNPVATEQYGCVCSNWGEDHNDENFGSDTQS

SEQ ID NO: 204124 - protein, 34 aa, Artificial Sequence
  Description of Artificial Sequence: Synthetic polypeptide
DDTEIASTNPIATECWGATTWAANETWAERVGPR

SEQ ID NO: 204125 - protein, 37 aa, Artificial Sequence
  Description of Artificial Sequence: Synthetic polypeptide
DEECISTVNPVATEGYGQCVCSNWGEHNENFGSDTQS

SEQ ID NO: 204126 - protein, 36 aa, Artificial Sequence
  Description of Artificial Sequence: Synthetic polypeptide
DEGEIATTNPVATEQWGGCCNAGNGHMNAASLDNAM

SEQ ID NO: 204127 - protein, 35 aa, Artificial Sequence
  Description of Artificial Sequence: Synthetic polypeptide
DETEIRTTNPIATEYWGATTWANAEDFAEPKGPYI

SEQ ID NO: 204128 - protein, 35 aa, Artificial Sequence
  Description of Artificial Sequence: Synthetic polypeptide
DETEIRTTNPIATEYWGATTWANAEDWAEPKGPYI

SEQ ID NO: 204129 - protein, 38 aa, Artificial Sequence
  Description of Artificial Sequence: Synthetic polypeptide
AEEEISTTNPVAYEQYGCVCSNWGEDHNAEYFMSDNQS

SEQ ID NO: 204130 - protein, 38 aa, Artificial Sequence
  Description of Artificial Sequence: Synthetic polypeptide
DEAEIRTTNPVATEPYGSTIPWPPPLEENQVHSQIEMQ

SEQ ID NO: 204131 - protein, 38 aa, Artificial Sequence
  Description of Artificial Sequence: Synthetic polypeptide
SETNEIATTNPVAYEQWGSVAYQVPNEEQGEQNGNDSS

SEQ ID NO: 204132 - protein, 37 aa, Artificial Sequence
  Description of Artificial Sequence: Synthetic polypeptide
DDEEIRTTNPVGYEQWGCVCSWGEDHNQENFGSVTQA

SEQ ID NO: 204133 - protein, 38 aa, Artificial Sequence
  Description of Artificial Sequence: Synthetic polypeptide
DEEEIRCTNPVAYEGYGQCVCFNWGEHNTENFGSDNQS

SEQ ID NO: 204134 - protein, 36 aa, Artificial Sequence
  Description of Artificial Sequence: Synthetic polypeptide
DETEIRTTNPIAYECWGIATTWANNEDGNEPKGPYI

SEQ ID NO: 204135 - protein, 37 aa, Artificial Sequence
  Description of Artificial Sequence: Synthetic polypeptide
DETEIRTTNPIAYEPWGHVNTNAVAEDQAEGGGVPAI

SEQ ID NO: 204136 - protein, 39 aa, Artificial Sequence
  Description of Artificial Sequence: Synthetic polypeptide
DEEEIRCTNPVAYEQYGQCVCSNSGEDHNAENFNSDNQA

SEQ ID NO: 204137 - protein, 37 aa, Artificial Sequence
  Description of Artificial Sequence: Synthetic polypeptide
DEECISTVNPVATEGYGCVCSWGEDHNTEYFNSDTQS

SEQ ID NO: 204138 - protein, 39 aa, Artificial Sequence
  Description of Artificial Sequence: Synthetic polypeptide
DEEEIRCTNPVAYEQYGQCVCSNWGEDHNQENFNSDNQG

SEQ ID NO: 204139 - protein, 35 aa, Artificial Sequence
  Description of Artificial Sequence: Synthetic polypeptide
DETEIRTTNPISTECWGATTWANAEDWQEPKGPYI

SEQ ID NO: 204140 - protein, 36 aa, Artificial Sequence
  Description of Artificial Sequence: Synthetic polypeptide
DETEIRTTNPISTECWGATTWANMEDIQAEPNGNYI

SEQ ID NO: 204141 - protein, 38 aa, Artificial Sequence
  Description of Artificial Sequence: Synthetic polypeptide
SETEIRCTWNPVATFSYGTSEASETGNLTENPNANHND

SEQ ID NO: 204142 - protein, 38 aa, Artificial Sequence
  Description of Artificial Sequence: Synthetic polypeptide
SETEIRCTWNPVATFQYNTSCNSDTINLTENPNANHND

SEQ ID NO: 204143 - protein, 34 aa, Artificial Sequence
  Description of Artificial Sequence: Synthetic polypeptide
DETEIRTTNPISTECWGATTWANMEDWAEPNGPH

SEQ ID NO: 204144 - protein, 35 aa, Artificial Sequence
  Description of Artificial Sequence: Synthetic polypeptide
DETEIRTTNPISTECWGATTWANMEDWQAEPNGPH

SEQ ID NO: 204145 - protein, 35 aa, Artificial Sequence
  Description of Artificial Sequence: Synthetic polypeptide
DETEIRTTNPISTECWGATTWSNAEDWQEPKGPYI

SEQ ID NO: 204146 - protein, 35 aa, Artificial Sequence
  Description of Artificial Sequence: Synthetic polypeptide
DETEIRTTNPISTECWGATTWSNAEDWQQPKGPYI

SEQ ID NO: 204147 - protein, 39 aa, Artificial Sequence
  Description of Artificial Sequence: Synthetic polypeptide
SETSEIRTTNPVAYEQWGTVCPTDNHGMVNGQKGENDIP

SEQ ID NO: 204148 - protein, 35 aa, Artificial Sequence
  Description of Artificial Sequence: Synthetic polypeptide
DETEIRTTNPIAYECWGATTWANNEDGARPKGPYI

SEQ ID NO: 204149 - protein, 35 aa, Artificial Sequence
  Description of Artificial Sequence: Synthetic polypeptide
DETEIRTTNPIAYECWGATTWANAERWAEPKGPYI

SEQ ID NO: 204150 - protein, 33 aa, Artificial Sequence
  Description of Artificial Sequence: Synthetic polypeptide
DEEEIATTNPIATECWGETWAAEDWAEPKEEYI

SEQ ID NO: 204151 - protein, 38 aa, Artificial Sequence
  Description of Artificial Sequence: Synthetic polypeptide
AEEEISTTNPVAYEQYGCVCSNWGEDHNQESFNSDNQA

SEQ ID NO: 204152 - protein, 36 aa, Artificial Sequence
  Description of Artificial Sequence: Synthetic polypeptide
DETEIRTTNPIATEYWGCQTCGNAEDDAEHSGSDNQ

SEQ ID NO: 204153 - protein, 38 aa, Artificial Sequence
  Description of Artificial Sequence: Synthetic polypeptide
AEEEISTTNPVAYEQYGCVCSNWGELHNAENFNSEFQG

SEQ ID NO: 204154 - protein, 38 aa, Artificial Sequence
  Description of Artificial Sequence: Synthetic polypeptide
DEGEIATTNPVATEQWGCVVATGGHQLDEATPDDNGQN

SEQ ID NO: 204155 - protein, 36 aa, Artificial Sequence
  Description of Artificial Sequence: Synthetic polypeptide
DETEIRTTNPIATEYWGCQTCPNAEDDAENSGSDNI

SEQ ID NO: 204156 - protein, 37 aa, Artificial Sequence
  Description of Artificial Sequence: Synthetic polypeptide
DEGEIATTNPVATEQWGCVVATGGHQDDEATPDDQHM

SEQ ID NO: 204157 - protein, 36 aa, Artificial Sequence
  Description of Artificial Sequence: Synthetic polypeptide
DETEIRTTNPIATEYWGCQTCQNAEEHAEYSGSDNI

SEQ ID NO: 204158 - protein, 36 aa, Artificial Sequence
  Description of Artificial Sequence: Synthetic polypeptide
DEACIRTTNGVAYCQYGCVCSWGEHNQENFNSDTQA

SEQ ID NO: 204159 - protein, 38 aa, Artificial Sequence
  Description of Artificial Sequence: Synthetic polypeptide
DDEEIRTVNPVAYEQYGCVCSNWMEDHNAENFNSQTQS

SEQ ID NO: 204160 - protein, 34 aa, Artificial Sequence
  Description of Artificial Sequence: Synthetic polypeptide
DEEEIATTNPIATECWGETTWANAVWAEHKEPYI

SEQ ID NO: 204161 - protein, 33 aa, Artificial Sequence
  Description of Artificial Sequence: Synthetic polypeptide
DEEEIATTNPIATECWGETWAAEDCAEPKEEYI

SEQ ID NO: 204162 - protein, 38 aa, Artificial Sequence
  Description of Artificial Sequence: Synthetic polypeptide
SEEEIACTNPVATEQYGSACNPTPDGLPLGAMEGFPDD

SEQ ID NO: 204163 - protein, 39 aa, Artificial Sequence
  Description of Artificial Sequence: Synthetic polypeptide
DEAEIRTTNPVATEPYGQSCFSIHLGTLWDEDISQNDDM

SEQ ID NO: 204164 - protein, 39 aa, Artificial Sequence
  Description of Artificial Sequence: Synthetic polypeptide
DEEEIRTTNPVSTEGYGQCVCGNWGEDHNAEGFNSQTQA

SEQ ID NO: 204165 - protein, 34 aa, Artificial Sequence
  Description of Artificial Sequence: Synthetic polypeptide
DETEIRTTNPIAYECWGATTWANAEDWAEPGPYI

SEQ ID NO: 204166 - protein, 36 aa, Artificial Sequence
  Description of Artificial Sequence: Synthetic polypeptide
SEEEIACTNPVATEQYGSCAAAMGHGPADSGEGDTV

SEQ ID NO: 204167 - protein, 38 aa, Artificial Sequence
  Description of Artificial Sequence: Synthetic polypeptide
DEAEISTTNPVAYEQYGQCVCSNSGEHNQEYFNSDTQA

SEQ ID NO: 204168 - protein, 36 aa, Artificial Sequence
  Description of Artificial Sequence: Synthetic polypeptide
CEEEIACTNPVAYEQYGSCAAAGGHHGNAEGGGQQN

SEQ ID NO: 204169 - protein, 35 aa, Artificial Sequence
  Description of Artificial Sequence: Synthetic polypeptide
DETEIRTTNPIAWECWGATAWTNAEDWEEPQEPQI

SEQ ID NO: 204170 - protein, 36 aa, Artificial Sequence
  Description of Artificial Sequence: Synthetic polypeptide
DETEIRTTNPIATECWGRATTWANACDWAEPKGPYI

SEQ ID NO: 204171 - protein, 38 aa, Artificial Sequence
  Description of Artificial Sequence: Synthetic polypeptide
DEAEISTTNPVAYEQYGCVCSMWEEDHNIESFNSDNQS

SEQ ID NO: 204172 - protein, 36 aa, Artificial Sequence
  Description of Artificial Sequence: Synthetic polypeptide
DETEIRTTNPIATECWGRATTRANAEDWAEPKGPYI

SEQ ID NO: 204173 - protein, 36 aa, Artificial Sequence
  Description of Artificial Sequence: Synthetic polypeptide
SEDELATTNPVATECWGCVCTIDSNNMNGQQGGQDA

SEQ ID NO: 204174 - protein, 36 aa, Artificial Sequence
  Description of Artificial Sequence: Synthetic polypeptide
SEDEMATTNPVATECWGCVCTIDSNNMNGQQGGDDD

SEQ ID NO: 204175 - protein, 35 aa, Artificial Sequence
  Description of Artificial Sequence: Synthetic polypeptide
DETEIRTTNPIATECWGATTWSNAEDWAEPKGPYI

SEQ ID NO: 204176 - protein, 37 aa, Artificial Sequence
  Description of Artificial Sequence: Synthetic polypeptide
SEDETIATTNPVATECWGCVCTIDSNNHNGQQGGDDA

SEQ ID NO: 204177 - protein, 39 aa, Artificial Sequence
  Description of Artificial Sequence: Synthetic polypeptide
TEACVIMRTTNPVAYTEQYGSTVTNDNHSMTANGGTNQA

SEQ ID NO: 204178 - protein, 39 aa, Artificial Sequence
  Description of Artificial Sequence: Synthetic polypeptide
CEEEISTTNPVATEQYGQCVCSNWGEDDNAENFNSDTAS

SEQ ID NO: 204179 - protein, 38 aa, Artificial Sequence
  Description of Artificial Sequence: Synthetic polypeptide
DEEEIGTTNPEATEQYGQCVCPNWGEHNAEYFGSDTQA

SEQ ID NO: 204180 - protein, 35 aa, Artificial Sequence
  Description of Artificial Sequence: Synthetic polypeptide
DETEIRTTNPIATECWGATTWSNAEDWMEPKGPYI

SEQ ID NO: 204181 - protein, 39 aa, Artificial Sequence
  Description of Artificial Sequence: Synthetic polypeptide
CEEEISTTNPVATEQYGQCVCSNWGEDDNAEYFNSETQA

SEQ ID NO: 204182 - protein, 38 aa, Artificial Sequence
  Description of Artificial Sequence: Synthetic polypeptide
MEEEIRGTNPVATEQYGDYGNPIMQMLLRMQSDGGGDV

SEQ ID NO: 204183 - protein, 36 aa, Artificial Sequence
  Description of Artificial Sequence: Synthetic polypeptide
SEEACEIAATNPVAYEPWGVCAMWINDQSDGRNGNM

SEQ ID NO: 204184 - protein, 37 aa, Artificial Sequence
  Description of Artificial Sequence: Synthetic polypeptide
DEAEIRTTNPVAYEQYGQCICSWEEHNAENFPSDTQS

SEQ ID NO: 204185 - protein, 38 aa, Artificial Sequence
  Description of Artificial Sequence: Synthetic polypeptide
DEGEIATTNPVATEQYGSTVCAANMGEEAPDSPMEEAH

SEQ ID NO: 204186 - protein, 38 aa, Artificial Sequence
  Description of Artificial Sequence: Synthetic polypeptide
DEMEIATTNPVAYEGYGCVCSNWGEDHNAEHFGSDNQS

SEQ ID NO: 204187 - protein, 32 aa, Artificial Sequence
  Description of Artificial Sequence: Synthetic polypeptide
QEGEIACTNPCSYEQWGITCYCNDQQDDGHTD

SEQ ID NO: 204188 - protein, 38 aa, Artificial Sequence
  Description of Artificial Sequence: Synthetic polypeptide
DDECISTTNPVATEQYGQCVCSNWGEDNAENFNSDNQA

SEQ ID NO: 204189 - protein, 35 aa, Artificial Sequence
  Description of Artificial Sequence: Synthetic polypeptide
DETEIRTTNPIATECWGATTWSNAEIWAEPKGPYI

SEQ ID NO: 204190 - protein, 36 aa, Artificial Sequence
  Description of Artificial Sequence: Synthetic polypeptide
TEAEIASTNPVAYEQWGSVVCGNAQLDHVDQSHDDQ

SEQ ID NO: 204191 - protein, 35 aa, Artificial Sequence
  Description of Artificial Sequence: Synthetic polypeptide
DETEIRTTNPIATECWGATTWSNAPDWAEPKGPYI

SEQ ID NO: 204192 - protein, 38 aa, Artificial Sequence
  Description of Artificial Sequence: Synthetic polypeptide
SECNEIATTNPVAYEQWGEVCSTPNQGNHGEAGGDGNN

SEQ ID NO: 204193 - protein, 33 aa, Artificial Sequence
  Description of Artificial Sequence: Synthetic polypeptide
TEAEIASTNPVGTEGWGVCAPTDRDQHQGQDVN

SEQ ID NO: 204194 - protein, 35 aa, Artificial Sequence
  Description of Artificial Sequence: Synthetic polypeptide
DETEIRTTNPIATECWGATTWNNAEDWAEPKGPII

SEQ ID NO: 204195 - protein, 35 aa, Artificial Sequence
  Description of Artificial Sequence: Synthetic polypeptide
DETEIRTTNPIATECWGATTWNNAEDWAEPKGPYI

SEQ ID NO: 204196 - protein, 35 aa, Artificial Sequence
  Description of Artificial Sequence: Synthetic polypeptide
DETEIRTTNPIATECWGATTWNNAEDWNEPKEPYP

SEQ ID NO: 204197 - protein, 34 aa, Artificial Sequence
  Description of Artificial Sequence: Synthetic polypeptide
DETEIRTTNPIATECWGATTWPAEDWAEHKGPYK

SEQ ID NO: 204198 - protein, 34 aa, Artificial Sequence
  Description of Artificial Sequence: Synthetic polypeptide
DETEIRTTNPIATECWGATTWPAEVWAEHKGPYK

SEQ ID NO: 204199 - protein, 35 aa, Artificial Sequence
  Description of Artificial Sequence: Synthetic polypeptide
DETEIRTTNPIATECWGATTWPNAEDWAEKMGPYI

SEQ ID NO: 204200 - protein, 35 aa, Artificial Sequence
  Description of Artificial Sequence: Synthetic polypeptide
DETEIRTTNPIATECWGATTWPNAEDWAEPKGPYI

SEQ ID NO: 204201 - protein, 35 aa, Artificial Sequence
  Description of Artificial Sequence: Synthetic polypeptide
DETEIRTTNPIATECWGATTWPNAEVWAEHKGEYI

SEQ ID NO: 204202 - protein, 35 aa, Artificial Sequence
  Description of Artificial Sequence: Synthetic polypeptide
DETEIRTTNPIATECWGATTWPNAEVWAEHKGPYI

SEQ ID NO: 204203 - protein, 35 aa, Artificial Sequence
  Description of Artificial Sequence: Synthetic polypeptide
DETEIRTTNPIATECWGATTWQNAEDWAEPKGPYI

SEQ ID NO: 204204 - protein, 35 aa, Artificial Sequence
  Description of Artificial Sequence: Synthetic polypeptide
DETEIRTTNPIATECWGATTWQNAVDWAEPQGPQI

SEQ ID NO: 204205 - protein, 35 aa, Artificial Sequence
  Description of Artificial Sequence: Synthetic polypeptide
DETEIRTTNPIATECWGATTWQRAEDWAEPKGPYI

SEQ ID NO: 204206 - protein, 35 aa, Artificial Sequence
  Description of Artificial Sequence: Synthetic polypeptide
DETEIRTTNPIATECWGATTWRNAEDWAEPKGPYI

SEQ ID NO: 204207 - protein, 35 aa, Artificial Sequence
  Description of Artificial Sequence: Synthetic polypeptide
DEHEIRTTNPIATECWGATTWANAEDWAEPKGPYI

SEQ ID NO: 204208 - protein, 35 aa, Artificial Sequence
  Description of Artificial Sequence: Synthetic polypeptide
DETEIRTTNPIATECWGATTWRNAEDWAEPSGPYI

SEQ ID NO: 204209 - protein, 35 aa, Artificial Sequence
  Description of Artificial Sequence: Synthetic polypeptide
TEAEIATTNPTATEAWGSIVPTWWDQHEHDQHTKP

SEQ ID NO: 204210 - protein, 38 aa, Artificial Sequence
  Description of Artificial Sequence: Synthetic polypeptide
SEDEIRTTNPVAYEQWGVACYTGDNLHNDQMTQGQIDD

SEQ ID NO: 204211 - protein, 33 aa, Artificial Sequence
  Description of Artificial Sequence: Synthetic polypeptide
TEAEIASTNPVGTEGWGVCAPTDRDQHNGDDAQ

SEQ ID NO: 204212 - protein, 38 aa, Artificial Sequence
  Description of Artificial Sequence: Synthetic polypeptide
MEEEIRGTNPVATECYGVVNMQGINNMDNQTGEFTEEG

SEQ ID NO: 204213 - protein, 39 aa, Artificial Sequence
  Description of Artificial Sequence: Synthetic polypeptide
DEAEIRTTNPVAYEQYGQCVCSNWGADDNAENFNSDTQS

SEQ ID NO: 204214 - protein, 35 aa, Artificial Sequence
  Description of Artificial Sequence: Synthetic polypeptide
DETEIRTTNPIATECWGATTWSNMEDWAEPKGPYI

SEQ ID NO: 204215 - protein, 38 aa, Artificial Sequence
  Description of Artificial Sequence: Synthetic polypeptide
SEEAISTTNPVATEQYGCVCSNWGEDHNAENFNSDTQA

SEQ ID NO: 204216 - protein, 35 aa, Artificial Sequence
  Description of Artificial Sequence: Synthetic polypeptide
DETEIRTTNPIATECWGATTWWNAEHWAEPKGPYI

SEQ ID NO: 204217 - protein, 35 aa, Artificial Sequence
  Description of Artificial Sequence: Synthetic polypeptide
DETEIRTTNPIATECWGATTWWNSEDWAEPKGPYI

SEQ ID NO: 204218 - protein, 35 aa, Artificial Sequence
  Description of Artificial Sequence: Synthetic polypeptide
DETEIRTTNPIATECWGATTWYNAEDWAEPKGPYI

SEQ ID NO: 204219 - protein, 38 aa, Artificial Sequence
  Description of Artificial Sequence: Synthetic polypeptide
SEEAISTTNPVATEQYGQCVCSNWGEHNAENFISENQA

SEQ ID NO: 204220 - protein, 37 aa, Artificial Sequence
  Description of Artificial Sequence: Synthetic polypeptide
DEACIATTNPVATCQYGCVCSNWGAHNQENFNSDTQS

SEQ ID NO: 204221 - protein, 35 aa, Artificial Sequence
  Description of Artificial Sequence: Synthetic polypeptide
DETEIRTTNPIATECWGATTWYNPEDWAEPKGPYI

SEQ ID NO: 204222 - protein, 38 aa, Artificial Sequence
  Description of Artificial Sequence: Synthetic polypeptide
SEEAISTTNPVATEQYGQCVCSNWGEHNAENFNSETQS

SEQ ID NO: 204223 - protein, 35 aa, Artificial Sequence
  Description of Artificial Sequence: Synthetic polypeptide
DETEIRTTNPIATECWGATTYANAEDWAEPKGPYI

SEQ ID NO: 204224 - protein, 35 aa, Artificial Sequence
  Description of Artificial Sequence: Synthetic polypeptide
DETEIRTTNPIATECWGATTYANPEDWAEPFGPYI

SEQ ID NO: 204225 - protein, 37 aa, Artificial Sequence
  Description of Artificial Sequence: Synthetic polypeptide
DEACICTTNPVAYEQYGCCTNVNCNAMTSQLHVGKSC

SEQ ID NO: 204226 - protein, 35 aa, Artificial Sequence
  Description of Artificial Sequence: Synthetic polypeptide
DETEIRTTNPIATECWGATVANAEDWAEPKGEPYG

SEQ ID NO: 204227 - protein, 38 aa, Artificial Sequence
  Description of Artificial Sequence: Synthetic polypeptide
MEEEIRCTNPVATDQYGSVVGMGEPGQGLDQGDDTEGG

SEQ ID NO: 204228 - protein, 38 aa, Artificial Sequence
  Description of Artificial Sequence: Synthetic polypeptide
DEACICTTNPVAYEQYGCSTSVNYCAMTSQTHVGKDSC

SEQ ID NO: 204229 - protein, 38 aa, Artificial Sequence
  Description of Artificial Sequence: Synthetic polypeptide
MEEEIRATNPVATEFYGCVVGSNQTDGGEFEEEGGEEY

SEQ ID NO: 204230 - protein, 38 aa, Artificial Sequence
  Description of Artificial Sequence: Synthetic polypeptide
STEEIRATNPVATEQYGDVMDLPNGEGAGQLTNEGGQE

SEQ ID NO: 204231 - protein, 36 aa, Artificial Sequence
  Description of Artificial Sequence: Synthetic polypeptide
DEECLSTTNPCAYEQYGCVCSWGEHNAEYFNSDTQS

SEQ ID NO: 204232 - protein, 35 aa, Artificial Sequence
  Description of Artificial Sequence: Synthetic polypeptide
DETEIRTTNPIATECWGATTWWNAEDWAEPKGPYI

SEQ ID NO: 204233 - protein, 38 aa, Artificial Sequence
  Description of Artificial Sequence: Synthetic polypeptide
DEAEIRTTNPVATEGWGQCVCSMWGEENQEYFGSDTQA

SEQ ID NO: 204234 - protein, 35 aa, Artificial Sequence
  Description of Artificial Sequence: Synthetic polypeptide
DETEIRTTNPIATECWGATTWVNIEDWAEPKGPYI

SEQ ID NO: 204235 - protein, 35 aa, Artificial Sequence
  Description of Artificial Sequence: Synthetic polypeptide
DETEIRTTNPIATECWGATTWVNAEDWAEPKGPYI

SEQ ID NO: 204236 - protein, 36 aa, Artificial Sequence
  Description of Artificial Sequence: Synthetic polypeptide
TDDEIRTTNPVAYEAWGSTVCFMQALSQTHSGTMDT

SEQ ID NO: 204237 - protein, 38 aa, Artificial Sequence
  Description of Artificial Sequence: Synthetic polypeptide
MEEEIRGTNPVATDQYGVVVGMGVNGQGLDQGDDTMGH

SEQ ID NO: 204238 - protein, 39 aa, Artificial Sequence
  Description of Artificial Sequence: Synthetic polypeptide
DEAEIRTTNPVAYEQYGQCVCSNWGEDHNAEFFNSDNQS

SEQ ID NO: 204239 - protein, 39 aa, Artificial Sequence
  Description of Artificial Sequence: Synthetic polypeptide
DEAEIRTTNPVAYEQYGQCVCSNWGEDHNAENFISENQS

SEQ ID NO: 204240 - protein, 39 aa, Artificial Sequence
  Description of Artificial Sequence: Synthetic polypeptide
DEAEIRTTNPVAYEQYGQCVCSNWGEDHNAENFNSDNQA

SEQ ID NO: 204241 - protein, 39 aa, Artificial Sequence
  Description of Artificial Sequence: Synthetic polypeptide
DEAEIRTTNPVAYEQYGQCVCSNWGEDHNAENFNSDNQS

SEQ ID NO: 204242 - protein, 39 aa, Artificial Sequence
  Description of Artificial Sequence: Synthetic polypeptide
DEAEIRTTNPVAYEQYGQCVCSNWGEDHNAENFNSDTQS

SEQ ID NO: 204243 - protein, 39 aa, Artificial Sequence
  Description of Artificial Sequence: Synthetic polypeptide
DEAEIRTTNPVAYEQYGQCVCSNWGEDHNAENFNSETQA

SEQ ID NO: 204244 - protein, 35 aa, Artificial Sequence
  Description of Artificial Sequence: Synthetic polypeptide
DETEIRTTNPIATECWGATTWMNAYDWAEPKGPYI

SEQ ID NO: 204245 - protein, 38 aa, Artificial Sequence
  Description of Artificial Sequence: Synthetic polypeptide
MEEEIRGTNPVATDQYGSVVGMGVPGQGLDNGDDTAGG

SEQ ID NO: 204246 - protein, 38 aa, Artificial Sequence
  Description of Artificial Sequence: Synthetic polypeptide
DEECISCTNPVATEQYGQCVCSNWGEHNAENFNSDTQS

SEQ ID NO: 204247 - protein, 36 aa, Artificial Sequence
  Description of Artificial Sequence: Synthetic polypeptide
DETEIRTTNPIATECWGATTWSTAEDWPAEPKGPYI

SEQ ID NO: 204248 - protein, 34 aa, Artificial Sequence
  Description of Artificial Sequence: Synthetic polypeptide
TATEIATTNPVAYEAWGEVAYIVQDHQERQGEHG

SEQ ID NO: 204249 - protein, 38 aa, Artificial Sequence
  Description of Artificial Sequence: Synthetic polypeptide
DEAAISTTNPVAYEQYGQCVCSWGEDHNTENFNSDNAS

SEQ ID NO: 204250 - protein, 35 aa, Artificial Sequence
  Description of Artificial Sequence: Synthetic polypeptide
DETEIRTTNPIATECWGATTWTNAEDWAEPKLPYI

SEQ ID NO: 204251 - protein, 34 aa, Artificial Sequence
  Description of Artificial Sequence: Synthetic polypeptide
EEVEIATTNPCVYEQWGCVYGNPPLGNAGEGDAG

SEQ ID NO: 204252 - protein, 36 aa, Artificial Sequence
  Description of Artificial Sequence: Synthetic polypeptide
DETEIRTTNPIATECWGATTWVNAEDLWAEPKGPYI

SEQ ID NO: 204253 - protein, 35 aa, Artificial Sequence
  Description of Artificial Sequence: Synthetic polypeptide
DETEIRTTNPIATECWGATTWVNAEDWAEPKGPTI

SEQ ID NO: 204254 - protein, 38 aa, Artificial Sequence
  Description of Artificial Sequence: Synthetic polypeptide
MEEEIRGTNPVATDQYGSVVGMGVPGQGIDVGDDTEGG

SEQ ID NO: 204255 - protein, 36 aa, Artificial Sequence
  Description of Artificial Sequence: Synthetic polypeptide
QAEEIATTNPVAYEQWGSTCAMNNGGEADIGGNESL

SEQ ID NO: 204256 - protein, 35 aa, Artificial Sequence
  Description of Artificial Sequence: Synthetic polypeptide
DETEIRTTNPIATECWGATTWMNAKDWAEPKGPYI

SEQ ID NO: 204257 - protein, 35 aa, Artificial Sequence
  Description of Artificial Sequence: Synthetic polypeptide
DETEIRTTNPIATECWGATTWMNAEDWAEPKGPYI

SEQ ID NO: 204258 - protein, 35 aa, Artificial Sequence
  Description of Artificial Sequence: Synthetic polypeptide
DETEIRTTNPIATECWGATTWASAEDDAEPKGPYI

SEQ ID NO: 204259 - protein, 38 aa, Artificial Sequence
  Description of Artificial Sequence: Synthetic polypeptide
DEECISCTNPVATEQYGCVCSNWGEDHNAENFNSDNQL

SEQ ID NO: 204260 - protein, 35 aa, Artificial Sequence
  Description of Artificial Sequence: Synthetic polypeptide
DETEIRTTNPIATECWGATTWASAEDWAEPKGPYI

SEQ ID NO: 204261 - protein, 35 aa, Artificial Sequence
  Description of Artificial Sequence: Synthetic polypeptide
DETEIRTTNPIATECWGATTWATAEDWAEPKGPYI

SEQ ID NO: 204262 - protein, 35 aa, Artificial Sequence
  Description of Artificial Sequence: Synthetic polypeptide
DETEIRTTNPIATECWGATTWATAEDWMEPKGPYI

SEQ ID NO: 204263 - protein, 34 aa, Artificial Sequence
  Description of Artificial Sequence: Synthetic polypeptide
DDSEVACTNPVSTEGYGCVCGNSTIQEYFGSQQM

SEQ ID NO: 204264 - protein, 35 aa, Artificial Sequence
  Description of Artificial Sequence: Synthetic polypeptide
DETEIRTTNPIATECWGATTWAVAEDWAEPKGPYI

SEQ ID NO: 204265 - protein, 35 aa, Artificial Sequence
  Description of Artificial Sequence: Synthetic polypeptide
EESEICSTNPVAYEPYGVVIVCDGAPSLPGGKERS

SEQ ID NO: 204266 - protein, 37 aa, Artificial Sequence
  Description of Artificial Sequence: Synthetic polypeptide
SEDEIATTNPVATECWGCVCTIDSNNHAGQQGGDDAT

SEQ ID NO: 204267 - protein, 39 aa, Artificial Sequence
  Description of Artificial Sequence: Synthetic polypeptide
CEEEISTTNPVATEQYGQCVCSNSGEDHNAENFGSDFAA

SEQ ID NO: 204268 - protein, 39 aa, Artificial Sequence
  Description of Artificial Sequence: Synthetic polypeptide
CEEEISTTNPVATEQYGQCVCSNSGEDDNAENFGSETQS

SEQ ID NO: 204269 - protein, 34 aa, Artificial Sequence
  Description of Artificial Sequence: Synthetic polypeptide
DDSEVACTNPVSTEGYGCVCATWEIQESFGSQQA

SEQ ID NO: 204270 - protein, 38 aa, Artificial Sequence
  Description of Artificial Sequence: Synthetic polypeptide
EESEIRTTNPVAYEQWGTVCPTDNHGVQNGQKGVDDQK

SEQ ID NO: 204271 - protein, 35 aa, Artificial Sequence
  Description of Artificial Sequence: Synthetic polypeptide
DETEIRTTNPIATECWGATTWAWAEDWAEPKGTRI

SEQ ID NO: 204272 - protein, 35 aa, Artificial Sequence
  Description of Artificial Sequence: Synthetic polypeptide
SEDEIACTNPVAYEQWGHSACAAADGQAGTPNESF

SEQ ID NO: 204273 - protein, 35 aa, Artificial Sequence
  Description of Artificial Sequence: Synthetic polypeptide
DDSEVACTNPVSTEGYGCVCANWEINQERFGSQQM

SEQ ID NO: 204274 - protein, 38 aa, Artificial Sequence
  Description of Artificial Sequence: Synthetic polypeptide
TEAEIRTTNPVATEWYGQAWYTYNTDPGMDLEINSYQE

SEQ ID NO: 204275 - protein, 38 aa, Artificial Sequence
  Description of Artificial Sequence: Synthetic polypeptide
DEECISCTNPVATEQYGCVCSNWGEDHNTENFNSDTQS

SEQ ID NO: 204276 - protein, 38 aa, Artificial Sequence
  Description of Artificial Sequence: Synthetic polypeptide
CEEEISTTNPVATEQYGQCVCPNWGEHNQENFISDTQA

SEQ ID NO: 204277 - protein, 35 aa, Artificial Sequence
  Description of Artificial Sequence: Synthetic polypeptide
DETEIRTTNPIATECWGATTWAQAEDWAEPKGTYI

SEQ ID NO: 204278 - protein, 36 aa, Artificial Sequence
  Description of Artificial Sequence: Synthetic polypeptide
SEDEIATTNPVATEQWGCVAAKPGEEMGDEQDNNDM

SEQ ID NO: 204279 - protein, 35 aa, Artificial Sequence
  Description of Artificial Sequence: Synthetic polypeptide
TEDEIASVNPVCYEPYGVTVNTIGNLSTAAGDNNV

SEQ ID NO: 204280 - protein, 34 aa, Artificial Sequence
  Description of Artificial Sequence: Synthetic polypeptide
TEDEIASVNPVCYEPYGVTVNDINLSTAANGNNV

SEQ ID NO: 204281 - protein, 34 aa, Artificial Sequence
  Description of Artificial Sequence: Synthetic polypeptide
TEDEIASVNPSCYEPYGVTVNTIGLSQAAGGNNV

SEQ ID NO: 204282 - protein, 35 aa, Artificial Sequence
  Description of Artificial Sequence: Synthetic polypeptide
DETEIRTTNPIATECWGATTWANTEDWAEPKGPYI

SEQ ID NO: 204283 - protein, 35 aa, Artificial Sequence
  Description of Artificial Sequence: Synthetic polypeptide
DETEIRTTNPIATECWGATTWANVEDWAEPKGPYI

SEQ ID NO: 204284 - protein, 35 aa, Artificial Sequence
  Description of Artificial Sequence: Synthetic polypeptide
DETEIRTTNPIATECWGATTWANVTDWAEPKGPYI

SEQ ID NO: 204285 - protein, 35 aa, Artificial Sequence
  Description of Artificial Sequence: Synthetic polypeptide
DETEIRTTNPIATECWGATTWANWEDWAEPKGPYI

SEQ ID NO: 204286 - protein, 35 aa, Artificial Sequence
  Description of Artificial Sequence: Synthetic polypeptide
DETEIRTTNPIATECWGATTWANWEDWSEPKGPYI

SEQ ID NO: 204287 - protein, 35 aa, Artificial Sequence
  Description of Artificial Sequence: Synthetic polypeptide
DETEIRTTNPIATECWGATTWANYEDWAEDKGPYI

SEQ ID NO: 204288 - protein, 35 aa, Artificial Sequence
  Description of Artificial Sequence: Synthetic polypeptide
DETEIRTTNPIATECWGATTWANYEDWAEPKGPYI

SEQ ID NO: 204289 - protein, 35 aa, Artificial Sequence
  Description of Artificial Sequence: Synthetic polypeptide
DETEIRTTNPIATECWGATTWANYEDWNEPKGPYI

SEQ ID NO: 204290 - protein, 38 aa, Artificial Sequence
  Description of Artificial Sequence: Synthetic polypeptide
AEAEISTTNPVATEQYGCVCSNWGEDHNAENFNSDTQS

SEQ ID NO: 204291 - protein, 34 aa, Artificial Sequence
  Description of Artificial Sequence: Synthetic polypeptide
DETEIRTTNPIATECWGATTWAPAEDWAPKGPYI

SEQ ID NO: 204292 - protein, 35 aa, Artificial Sequence
  Description of Artificial Sequence: Synthetic polypeptide
DETEIRTTNPIATECWGATTWAQAEDHAEPKGPYI

SEQ ID NO: 204293 - protein, 38 aa, Artificial Sequence
  Description of Artificial Sequence: Synthetic polypeptide
DENEIKTTNCVATECYGVVSVVDNTNMDGENDEGFDGT

SEQ ID NO: 204294 - protein, 38 aa, Artificial Sequence
  Description of Artificial Sequence: Synthetic polypeptide
AEAEISTTNPVATEQYGCVCSNWGEDHNQENFNSDNQS

SEQ ID NO: 204295 - protein, 35 aa, Artificial Sequence
  Description of Artificial Sequence: Synthetic polypeptide
DETEIRTTNPIATECWGATTWAQAEDWAEPKGPYI

SEQ ID NO: 204296 - protein, 36 aa, Artificial Sequence
  Description of Artificial Sequence: Synthetic polypeptide
SEDEIATTNPVVTECWGCVCTIDSNNHNGQQGGDDA

SEQ ID NO: 204297 - protein, 38 aa, Artificial Sequence
  Description of Artificial Sequence: Synthetic polypeptide
DEEEIGTTNPVATEQYGCFCSNWPEDHNQENFDSDTQS

SEQ ID NO: 204298 - protein, 35 aa, Artificial Sequence
  Description of Artificial Sequence: Synthetic polypeptide
DETEIRTTNPIATECWGATTWCNAEDKAEPKGPYI

SEQ ID NO: 204299 - protein, 38 aa, Artificial Sequence
  Description of Artificial Sequence: Synthetic polypeptide
DDECISTTNPVATEQYGQCVCSNWGEDNAENFNSETQA

SEQ ID NO: 204300 - protein, 35 aa, Artificial Sequence
  Description of Artificial Sequence: Synthetic polypeptide
DETEIRTTNPIATECWGATTWFNAETWAEPKGPYI

SEQ ID NO: 204301 - protein, 35 aa, Artificial Sequence
  Description of Artificial Sequence: Synthetic polypeptide
DETEIRTTNPIATECWGATTWGNAEDWAEPCGPYI

SEQ ID NO: 204302 - protein, 35 aa, Artificial Sequence
  Description of Artificial Sequence: Synthetic polypeptide
DETEIRTTNPIATECWGATTWGNAEDWAEPKGPYI

SEQ ID NO: 204303 - protein, 35 aa, Artificial Sequence
  Description of Artificial Sequence: Synthetic polypeptide
DETEIRTTNPIATECWGATTWHNAEDWAEPKGPYI

SEQ ID NO: 204304 - protein, 35 aa, Artificial Sequence
  Description of Artificial Sequence: Synthetic polypeptide
DETEIRTTNPIATECWGATTWHQAEDWKEPKGPYI

SEQ ID NO: 204305 - protein, 39 aa, Artificial Sequence
  Description of Artificial Sequence: Synthetic polypeptide
DEEEIGTTNPVATEGYGQCVCSNWGEDHDQENFGSETQS

SEQ ID NO: 204306 - protein, 35 aa, Artificial Sequence
  Description of Artificial Sequence: Synthetic polypeptide
DETEIRTTNPIATECWGATTWINAEDWAEPKGPYI

SEQ ID NO: 204307 - protein, 35 aa, Artificial Sequence
  Description of Artificial Sequence: Synthetic polypeptide
DETEIRTTNPIATECWGATTWINTEDWAEPKGPYI

SEQ ID NO: 204308 - protein, 36 aa, Artificial Sequence
  Description of Artificial Sequence: Synthetic polypeptide
EENEIRTTNPVSTEVYGTVQTSPMDIEIQQNDTATH

SEQ ID NO: 204309 - protein, 38 aa, Artificial Sequence
  Description of Artificial Sequence: Synthetic polypeptide
DEAAISTTNPVATEQYGCVCSNWGEDHNAENFNSDNQA

SEQ ID NO: 204310 - protein, 36 aa, Artificial Sequence
  Description of Artificial Sequence: Synthetic polypeptide
DETEIRTTNPIATECWGATTWKNAEDRWAEPKGPYI

SEQ ID NO: 204311 - protein, 35 aa, Artificial Sequence
  Description of Artificial Sequence: Synthetic polypeptide
DETEIRTTNPIATECWGATTWKNAEDWAEPKGPYI

SEQ ID NO: 204312 - protein, 35 aa, Artificial Sequence
  Description of Artificial Sequence: Synthetic polypeptide
DETEIRTTNPIATECWGATTWKNAEDWAEPVGPYI

SEQ ID NO: 204313 - protein, 38 aa, Artificial Sequence
  Description of Artificial Sequence: Synthetic polypeptide
DEAAISTTNPVATEQYGCVCSNWGEDHNAENFNSDTQS

SEQ ID NO: 204314 - protein, 35 aa, Artificial Sequence
  Description of Artificial Sequence: Synthetic polypeptide
DETEIRTTNPIATECWGATTWLEAEDWAEPKGPYI

SEQ ID NO: 204315 - protein, 35 aa, Artificial Sequence
  Description of Artificial Sequence: Synthetic polypeptide
DETEIRTTNPIATECWGATTWLNAEDAAEPKGPYI

SEQ ID NO: 204316 - protein, 35 aa, Artificial Sequence
  Description of Artificial Sequence: Synthetic polypeptide
DETEIRTTNPIATECWGATTWLNAEDWAEPKGPYI

SEQ ID NO: 204317 - protein, 35 aa, Artificial Sequence
  Description of Artificial Sequence: Synthetic polypeptide
DETEIRTTNPIATECWGATTWFNAEKWAEPKGPYI

SEQ ID NO: 204318 - protein, 38 aa, Artificial Sequence
  Description of Artificial Sequence: Synthetic polypeptide
DEAAISTTNPVATEQYGCVCSNWGEDHNAENFISDNQS

SEQ ID NO: 204319 - protein, 39 aa, Artificial Sequence
  Description of Artificial Sequence: Synthetic polypeptide
TEAEIRTTNPVATEPYGQSTCSITLGTLWDEDISQNDDM

SEQ ID NO: 204320 - protein, 35 aa, Artificial Sequence
  Description of Artificial Sequence: Synthetic polypeptide
DETEIRTTNPIATECWGATTWFNAEDWEEPQHPQI

SEQ ID NO: 204321 - protein, 39 aa, Artificial Sequence
  Description of Artificial Sequence: Synthetic polypeptide
CEEEISTTNPVATEQYGQCQVCSWGEDHNAENFNSDTQP

SEQ ID NO: 204322 - protein, 35 aa, Artificial Sequence
  Description of Artificial Sequence: Synthetic polypeptide
DETEIRTTNPIATECWGATTWCNAEDWAEPKGPII

SEQ ID NO: 204323 - protein, 35 aa, Artificial Sequence
  Description of Artificial Sequence: Synthetic polypeptide
DETEIRTTNPIATECWGATTWCNAEDWAEPKGPYI

SEQ ID NO: 204324 - protein, 35 aa, Artificial Sequence
  Description of Artificial Sequence: Synthetic polypeptide
DETEIRTTNPIATECWGATTWCNAEDWAEPPGPDI

SEQ ID NO: 204325 - protein, 39 aa, Artificial Sequence
  Description of Artificial Sequence: Synthetic polypeptide
CEEEISTTNPVATEQYGQCQVCSNWGEHNAENFNSETQS

SEQ ID NO: 204326 - protein, 35 aa, Artificial Sequence
  Description of Artificial Sequence: Synthetic polypeptide
DETEIRTTNPIATECWGATTWDNAEDWAEPKGPYI

SEQ ID NO: 204327 - protein, 35 aa, Artificial Sequence
  Description of Artificial Sequence: Synthetic polypeptide
DETEIRTTNPIATECWGATTWDNHEDGAEPKGPYI

SEQ ID NO: 204328 - protein, 35 aa, Artificial Sequence
  Description of Artificial Sequence: Synthetic polypeptide
DETEIRTTNPIATECWGATTWENAEDAAEPKGPYI

SEQ ID NO: 204329 - protein, 35 aa, Artificial Sequence
  Description of Artificial Sequence: Synthetic polypeptide
DETEIRTTNPIATECWGATTWMNAEDWAEPKGPYY

SEQ ID NO: 204330 - protein, 37 aa, Artificial Sequence
  Description of Artificial Sequence: Synthetic polypeptide
SEDEIACTNPVATEQYGCVAGNGVADEAGTPPDNNPQ

SEQ ID NO: 204331 - protein, 35 aa, Artificial Sequence
  Description of Artificial Sequence: Synthetic polypeptide
DETEIRTTNPIATECWGATTWENAEDWAECKGPYI

SEQ ID NO: 204332 - protein, 39 aa, Artificial Sequence
  Description of Artificial Sequence: Synthetic polypeptide
DEEEIGTTNPVATEGYGQCVCSNWGEDHNAENFNSDTQS

SEQ ID NO: 204333 - protein, 35 aa, Artificial Sequence
  Description of Artificial Sequence: Synthetic polypeptide
DETEIRTTNPIATECWGATTWENAEDWAEPKGPYI

SEQ ID NO: 204334 - protein, 37 aa, Artificial Sequence
  Description of Artificial Sequence: Synthetic polypeptide
DEAAISTTNPVATEQYGCFCSWMEDHNIENFGSDTQS

SEQ ID NO: 204335 - protein, 35 aa, Artificial Sequence
  Description of Artificial Sequence: Synthetic polypeptide
DETEIRTTNPIATECWGATTWENAEDWAEPLGPYI

SEQ ID NO: 204336 - protein, 35 aa, Artificial Sequence
  Description of Artificial Sequence: Synthetic polypeptide
DETEIRTTNPIATECWGATTWFNAEDWAEPKGPYI

SEQ ID NO: 204337 - protein, 35 aa, Artificial Sequence
  Description of Artificial Sequence: Synthetic polypeptide
DETEIRTTNPIATECWGATTWFNAEDWAEPKGYYI

SEQ ID NO: 204338 - protein, 39 aa, Artificial Sequence
  Description of Artificial Sequence: Synthetic polypeptide
DEEEIGTTNPVATEGYGQCVCSNWGEDHNAENFNSDTQA

SEQ ID NO: 204339 - protein, 39 aa, Artificial Sequence
  Description of Artificial Sequence: Synthetic polypeptide
DEECISCTNPVATEQYGCQVCSNWEEDHNTENFNSDNQA

SEQ ID NO: 204340 - protein, 35 aa, Artificial Sequence
  Description of Artificial Sequence: Synthetic polypeptide
DETEIRTTNPIATECWGATVWANAEDWAEPKEPYI

SEQ ID NO: 204341 - protein, 35 aa, Artificial Sequence
  Description of Artificial Sequence: Synthetic polypeptide
SSSEVASTNPVSTEPYGNVACNTEISQSRTGGQRN

SEQ ID NO: 204342 - protein, 37 aa, Artificial Sequence
  Description of Artificial Sequence: Synthetic polypeptide
SSSEISTTNPVATEQYGASAVVATVPHIIEGEEPQED

SEQ ID NO: 204343 - protein, 36 aa, Artificial Sequence
  Description of Artificial Sequence: Synthetic polypeptide
DETEIRTTNPIATECWGIATTWANAEDWAEPDGPYI

SEQ ID NO: 204344 - protein, 38 aa, Artificial Sequence
  Description of Artificial Sequence: Synthetic polypeptide
DEAEISTTNPVAYEQYGCVCSNWGEDHNAENFNSDNQS

SEQ ID NO: 204345 - protein, 39 aa, Artificial Sequence
  Description of Artificial Sequence: Synthetic polypeptide
AEEEIRTTNPVATEQYGQCVCSNWMEDHNAENFPSQTQS

SEQ ID NO: 204346 - protein, 36 aa, Artificial Sequence
  Description of Artificial Sequence: Synthetic polypeptide
DETEIRTTNPIATECWGIATTWANAEDWAEPKGPYI

SEQ ID NO: 204347 - protein, 36 aa, Artificial Sequence
  Description of Artificial Sequence: Synthetic polypeptide
DETEIRTTNPIATECWGIATTWANAEDYYEPKGPYI

SEQ ID NO: 204348 - protein, 35 aa, Artificial Sequence
  Description of Artificial Sequence: Synthetic polypeptide
DETEIRTTNPIATECWGITTWANAEDWAEPKGPYI

SEQ ID NO: 204349 - protein, 38 aa, Artificial Sequence
  Description of Artificial Sequence: Synthetic polypeptide
DEAEISTTNPVAYEQYGQCVCGNWGEHNQENFNSDTQA

SEQ ID NO: 204350 - protein, 35 aa, Artificial Sequence
  Description of Artificial Sequence: Synthetic polypeptide
DETEIRTTNPIATECWGITTWANAEDWCEPKGPYI

SEQ ID NO: 204351 - protein, 38 aa, Artificial Sequence
  Description of Artificial Sequence: Synthetic polypeptide
ADEEIRTTNPVATEQWGCVTSNWGEDDNQENFNSDTAS

SEQ ID NO: 204352 - protein, 35 aa, Artificial Sequence
  Description of Artificial Sequence: Synthetic polypeptide
DETEIRTTNPIATECWGITTWANAWDWAEPKGPYI

SEQ ID NO: 204353 - protein, 35 aa, Artificial Sequence
  Description of Artificial Sequence: Synthetic polypeptide
DETEIRTTNPIATECWGITTWDNAEDWAEPKGPYI

SEQ ID NO: 204354 - protein, 38 aa, Artificial Sequence
  Description of Artificial Sequence: Synthetic polypeptide
DEAEISTTNPVAYEQYGCVCSNWGEDHNAENFISENQA

SEQ ID NO: 204355 - protein, 39 aa, Artificial Sequence
  Description of Artificial Sequence: Synthetic polypeptide
DEEEIATTNPVATEQYGQCVCSNWMEDHNAENFSSQTQS

SEQ ID NO: 204356 - protein, 36 aa, Artificial Sequence
  Description of Artificial Sequence: Synthetic polypeptide
DETEIRTTNPIATECWGKATTEANAEDWAEPKGPYI

SEQ ID NO: 204357 - protein, 36 aa, Artificial Sequence
  Description of Artificial Sequence: Synthetic polypeptide
DETEIRTTNPIATECWGKATTWANAEDTAEPKGPYI

SEQ ID NO: 204358 - protein, 36 aa, Artificial Sequence
  Description of Artificial Sequence: Synthetic polypeptide
DETEIRTTNPIATECWGKATTWANAEDWAEPKGPYI

SEQ ID NO: 204359 - protein, 36 aa, Artificial Sequence
  Description of Artificial Sequence: Synthetic polypeptide
DETEIRTTNPIATECWGKATTWANAEDWFEPKGPYI

SEQ ID NO: 204360 - protein, 37 aa, Artificial Sequence
  Description of Artificial Sequence: Synthetic polypeptide
QAEEIATTNPVAYEQWGSVCAMNNGNLEPDIGGTDSW

SEQ ID NO: 204361 - protein, 36 aa, Artificial Sequence
  Description of Artificial Sequence: Synthetic polypeptide
DETEIRTTNPIATECWGKATTWANAEIWAEPKGPYI

SEQ ID NO: 204362 - protein, 35 aa, Artificial Sequence
  Description of Artificial Sequence: Synthetic polypeptide
DETEIRTTNPIATECWGHTTWANAEDWAEPKGPYI

SEQ ID NO: 204363 - protein, 36 aa, Artificial Sequence
  Description of Artificial Sequence: Synthetic polypeptide
DETEIRTTNPIATECWGHATTWANAEDWAEPKGPYI

SEQ ID NO: 204364 - protein, 36 aa, Artificial Sequence
  Description of Artificial Sequence: Synthetic polypeptide
DETEIRTTNPIATECWGETTWANAEDWAEPKGNPYI

SEQ ID NO: 204365 - protein, 35 aa, Artificial Sequence
  Description of Artificial Sequence: Synthetic polypeptide
DETEIRTTNPIATECWGETTWANAEDWAEPKGPYI

SEQ ID NO: 204366 - protein, 35 aa, Artificial Sequence
  Description of Artificial Sequence: Synthetic polypeptide
DETEIRTTNPIATECWGETTWANAEDWAEPKGPYY

SEQ ID NO: 204367 - protein, 35 aa, Artificial Sequence
  Description of Artificial Sequence: Synthetic polypeptide
DETEIRTTNPIATECWGETTWANEEDWAEPKGGYI

SEQ ID NO: 204368 - protein, 33 aa, Artificial Sequence
  Description of Artificial Sequence: Synthetic polypeptide
QEGEIACTNPCSYEQWGITCYCNDQIDQGDTRH

SEQ ID NO: 204369 - protein, 35 aa, Artificial Sequence
  Description of Artificial Sequence: Synthetic polypeptide
DETEIRTTNPIATECWGETTWANEEDWAEPKGPYI

SEQ ID NO: 204370 - protein, 36 aa, Artificial Sequence
  Description of Artificial Sequence: Synthetic polypeptide
DETEIRTTNPIATECWGFATTWANAEDWAEPKGPYI

SEQ ID NO: 204371 - protein, 36 aa, Artificial Sequence
  Description of Artificial Sequence: Synthetic polypeptide
DETEIRTTNPIATECWGFATTWANAEDWAETKGPYI

SEQ ID NO: 204372 - protein, 36 aa, Artificial Sequence
  Description of Artificial Sequence: Synthetic polypeptide
DETEIRTTNPIATECWGFATTWDNAEDWAEPKGPYI

SEQ ID NO: 204373 - protein, 35 aa, Artificial Sequence
  Description of Artificial Sequence: Synthetic polypeptide
DETEIRTTNPIATECWGFTTWANAEDCAEPKGPYI

SEQ ID NO: 204374 - protein, 35 aa, Artificial Sequence
  Description of Artificial Sequence: Synthetic polypeptide
DETEIRTTNPIATECWGFTTWANAEDWAEPKGPYI

SEQ ID NO: 204375 - protein, 36 aa, Artificial Sequence
  Description of Artificial Sequence: Synthetic polypeptide
DETEIRTTNPIATECWGGATTWANAEDDAEPKGPYI

SEQ ID NO: 204376 - protein, 37 aa, Artificial Sequence
  Description of Artificial Sequence: Synthetic polypeptide
SEECISCTNPVATEQYGCVCSNWGEDNAEYFNSDNQS

SEQ ID NO: 204377 - protein, 35 aa, Artificial Sequence
  Description of Artificial Sequence: Synthetic polypeptide
DETEIRTTNPIATECWGGTTWANAEDWAEPKGPYI

SEQ ID NO: 204378 - protein, 38 aa, Artificial Sequence
  Description of Artificial Sequence: Synthetic polypeptide
SEECISCTNPVATEQYGQCVCSNWGEDNAENFGSDNQS

SEQ ID NO: 204379 - protein, 37 aa, Artificial Sequence
  Description of Artificial Sequence: Synthetic polypeptide
CEEEIACTNPVATEQYGCTACAGANGPQEDAGEPEMW

SEQ ID NO: 204380 - protein, 38 aa, Artificial Sequence
  Description of Artificial Sequence: Synthetic polypeptide
DEAEISTTNPVAYEQYGCVCSNWGEDHNAENSNSENQA

SEQ ID NO: 204381 - protein, 35 aa, Artificial Sequence
  Description of Artificial Sequence: Synthetic polypeptide
DETEIRTTNPIATECWGHTTWANAEDIAEPKGPYI

SEQ ID NO: 204382 - protein, 36 aa, Artificial Sequence
  Description of Artificial Sequence: Synthetic polypeptide
DETEIRTTNPIATECWGKNTTWANAEDWAEPKGPYI

SEQ ID NO: 204383 - protein, 35 aa, Artificial Sequence
  Description of Artificial Sequence: Synthetic polypeptide
MEDEIRGTNCVATEAWGVVSAINGEGGDGEEGEQN

SEQ ID NO: 204384 - protein, 35 aa, Artificial Sequence
  Description of Artificial Sequence: Synthetic polypeptide
DETEIRTTNPIATECWGKTTPANAEHWAEPAGPYI

SEQ ID NO: 204385 - protein, 36 aa, Artificial Sequence
  Description of Artificial Sequence: Synthetic polypeptide
MEDEIRGTNCVATEAWGSVSAIEGEGGDGEGEENQS

SEQ ID NO: 204386 - protein, 38 aa, Artificial Sequence
  Description of Artificial Sequence: Synthetic polypeptide
SQEEISTTNPVATEQWGQCVCSNWGEHNAEYFGSDNQA

SEQ ID NO: 204387 - protein, 36 aa, Artificial Sequence
  Description of Artificial Sequence: Synthetic polypeptide
MEDEIRGTNCVATEAWGIVSAINGEGGDGEGEENQN

SEQ ID NO: 204388 - protein, 37 aa, Artificial Sequence
  Description of Artificial Sequence: Synthetic polypeptide
SQEEISTTNPVATEQWGCVCSWGEDHNAEYFNSDTQA

SEQ ID NO: 204389 - protein, 38 aa, Artificial Sequence
  Description of Artificial Sequence: Synthetic polypeptide
SEECISTTNPVATEQYGQCVCSNWGEENAENFGSDTQS

SEQ ID NO: 204390 - protein, 35 aa, Artificial Sequence
  Description of Artificial Sequence: Synthetic polypeptide
DETEIRTTNPIATECWGQTTWANAEDWAEPKGPEI

SEQ ID NO: 204391 - protein, 35 aa, Artificial Sequence
  Description of Artificial Sequence: Synthetic polypeptide
DETEIRTTNPIATECWGQTTWANAEDWAEPKGPYI

SEQ ID NO: 204392 - protein, 38 aa, Artificial Sequence
  Description of Artificial Sequence: Synthetic polypeptide
SEECISTTNPVATEQYGQCVCSNWGEHDQESFNSDTQS

SEQ ID NO: 204393 - protein, 38 aa, Artificial Sequence
  Description of Artificial Sequence: Synthetic polypeptide
SEECISTTNPVATEQYGQCVCSNWGEHNAENFNSETQA

SEQ ID NO: 204394 - protein, 38 aa, Artificial Sequence
  Description of Artificial Sequence: Synthetic polypeptide
SEECISTTNPVATEQYGQCVCSNWGEHNQENFNSDTQS

SEQ ID NO: 204395 - protein, 38 aa, Artificial Sequence
  Description of Artificial Sequence: Synthetic polypeptide
SQEEISTTNPVATEQWGCVCSNWGEDHNQEYFGSDNQA

SEQ ID NO: 204396 - protein, 38 aa, Artificial Sequence
  Description of Artificial Sequence: Synthetic polypeptide
EEENEIATTNPVAYEQWGVVCYQVTTNEHNQVDDNDGN

SEQ ID NO: 204397 - protein, 37 aa, Artificial Sequence
  Description of Artificial Sequence: Synthetic polypeptide
DEAEIATTNPVATCQYGCVCSMWGAHNAENFISDTQS

SEQ ID NO: 204398 - protein, 39 aa, Artificial Sequence
  Description of Artificial Sequence: Synthetic polypeptide
DEMCIRTTNPVATEGYGICVTSTWGADHNAENFNSDPQA

SEQ ID NO: 204399 - protein, 35 aa, Artificial Sequence
  Description of Artificial Sequence: Synthetic polypeptide
DETEIRTTNPIATECWGQTTWANAEDWAEPKGWYI

SEQ ID NO: 204400 - protein, 35 aa, Artificial Sequence
  Description of Artificial Sequence: Synthetic polypeptide
DETEIRTTNPIATECWGQTTWANAEDWANPKGPYI

SEQ ID NO: 204401 - protein, 38 aa, Artificial Sequence
  Description of Artificial Sequence: Synthetic polypeptide
DEAEISTTNPVAYEQYGCVCSNWEEDHNAENFNSDTQS

SEQ ID NO: 204402 - protein, 35 aa, Artificial Sequence
  Description of Artificial Sequence: Synthetic polypeptide
DETEIRTTNPIATECWGQTTPANAEDWTEPKGPYI

SEQ ID NO: 204403 - protein, 36 aa, Artificial Sequence
  Description of Artificial Sequence: Synthetic polypeptide
DETEIRTTNPIATECWGQATTWANAEDWAEPKGPYI

SEQ ID NO: 204404 - protein, 36 aa, Artificial Sequence
  Description of Artificial Sequence: Synthetic polypeptide
DETEIRTTNPIATECWGQATTWANAEDWAEPCGPYI

SEQ ID NO: 204405 - protein, 37 aa, Artificial Sequence
  Description of Artificial Sequence: Synthetic polypeptide
DETEIRTTNPIATECWGQATTWANAEDLWAEPKGPYI

SEQ ID NO: 204406 - protein, 35 aa, Artificial Sequence
  Description of Artificial Sequence: Synthetic polypeptide
DETEIRTTNPIATECWGKTTWACAEDQAEPKGPYI

SEQ ID NO: 204407 - protein, 35 aa, Artificial Sequence
  Description of Artificial Sequence: Synthetic polypeptide
DETEIRTTNPIATECWGKTTWANAEDWAEPKGPYI

SEQ ID NO: 204408 - protein, 36 aa, Artificial Sequence
  Description of Artificial Sequence: Synthetic polypeptide
DETEIRTTNPIATECWGLATTWANAEDSAEPKGPYI

SEQ ID NO: 204409 - protein, 36 aa, Artificial Sequence
  Description of Artificial Sequence: Synthetic polypeptide
DETEIRTTNPIATECWGLATTWVNAEDWAEPKGPYI

SEQ ID NO: 204410 - protein, 35 aa, Artificial Sequence
  Description of Artificial Sequence: Synthetic polypeptide
DETEIRTTNPIATECWGLITWANAEDWAEPKGPYI

SEQ ID NO: 204411 - protein, 35 aa, Artificial Sequence
  Description of Artificial Sequence: Synthetic polypeptide
DETEIRTTNPIATECWGLTTWANAEDWAEGKGPYI

SEQ ID NO: 204412 - protein, 35 aa, Artificial Sequence
  Description of Artificial Sequence: Synthetic polypeptide
DETEIRTTNPIATECWGLTTWANAEDWAEPKGPYI

SEQ ID NO: 204413 - protein, 36 aa, Artificial Sequence
  Description of Artificial Sequence: Synthetic polypeptide
DETEIRTTNPIATECWGMATTWANAEDWAEPKGPYI

SEQ ID NO: 204414 - protein, 38 aa, Artificial Sequence
  Description of Artificial Sequence: Synthetic polypeptide
SECAEIATTNPVAYEQWGVCVQWETNNDTERPGGGGRQ

SEQ ID NO: 204415 - protein, 36 aa, Artificial Sequence
  Description of Artificial Sequence: Synthetic polypeptide
DETEIRTTNPIATECWGMATTWANCEDWAEPKGPYI

SEQ ID NO: 204416 - protein, 36 aa, Artificial Sequence
  Description of Artificial Sequence: Synthetic polypeptide
DETEIRTTNPIATECWGNATTRANAEDWAEPKGPYI

SEQ ID NO: 204417 - protein, 36 aa, Artificial Sequence
  Description of Artificial Sequence: Synthetic polypeptide
DETEIRTTNPIATECWGNATTWANAEDWAEPKGPYI

SEQ ID NO: 204418 - protein, 35 aa, Artificial Sequence
  Description of Artificial Sequence: Synthetic polypeptide
DETEIRTTNPIATECWGNTTWANAEDVAEPKGPYI

SEQ ID NO: 204419 - protein, 35 aa, Artificial Sequence
  Description of Artificial Sequence: Synthetic polypeptide
DETEIRTTNPIATECWGNTTWANAEDWAEPKGPYI

SEQ ID NO: 204420 - protein, 35 aa, Artificial Sequence
  Description of Artificial Sequence: Synthetic polypeptide
DETEIRTTNPIATECWGNTTWANAEDWAEPKNPYI

SEQ ID NO: 204421 - protein, 36 aa, Artificial Sequence
  Description of Artificial Sequence: Synthetic polypeptide
DETEIRTTNPIATECWGQACTWANAEDWAEPKGPYI

SEQ ID NO: 204422 - protein, 36 aa, Artificial Sequence
  Description of Artificial Sequence: Synthetic polypeptide
DETEIRTTNPIATECWGQAITWANAEDWAEPKGPYI

SEQ ID NO: 204423 - protein, 36 aa, Artificial Sequence
  Description of Artificial Sequence: Synthetic polypeptide
DETEIRTTNPIATECWGQATTWANAADWAEPMGPYI

SEQ ID NO: 204424 - protein, 35 aa, Artificial Sequence
  Description of Artificial Sequence: Synthetic polypeptide
DETEIRTTNPIATECWGMTTWANAEDWAEPKGPYI

SEQ ID NO: 204425 - protein, 38 aa, Artificial Sequence
  Description of Artificial Sequence: Synthetic polypeptide
DEAEIRTTNPVATEGWGQCVCSNWMEENAEYFNSDTQS

SEQ ID NO: 204426 - protein, 39 aa, Artificial Sequence
  Description of Artificial Sequence: Synthetic polypeptide
AEEEIRTTNPVATEQYGQCVCSNWGEDHNAEHFSSDTQA

SEQ ID NO: 204427 - protein, 35 aa, Artificial Sequence
  Description of Artificial Sequence: Synthetic polypeptide
DETEIRTTNPIATECWGETIWANAEDWAEPKGPYI

SEQ ID NO: 204428 - protein, 38 aa, Artificial Sequence
  Description of Artificial Sequence: Synthetic polypeptide
DENEIRATNPVATEQYGVVVMDPEGGDEEGNGEGEDLV

SEQ ID NO: 204429 - protein, 37 aa, Artificial Sequence
  Description of Artificial Sequence: Synthetic polypeptide
DEECISCTNPVATEAYGCVCSNWGEDNAENFNSDTQS

SEQ ID NO: 204430 - protein, 35 aa, Artificial Sequence
  Description of Artificial Sequence: Synthetic polypeptide
DETEIRTTNPIATECWGATWANAEDWPAEPKGPPI

SEQ ID NO: 204431 - protein, 39 aa, Artificial Sequence
  Description of Artificial Sequence: Synthetic polypeptide
CEEEISTTNPVATEQYGQCVCSNWGEDHNQENFGSDTQA

SEQ ID NO: 204432 - protein, 39 aa, Artificial Sequence
  Description of Artificial Sequence: Synthetic polypeptide
AEAEISTTNPVATEQYGQCVCSTWGEDHNIENFNSDTQA

SEQ ID NO: 204433 - protein, 33 aa, Artificial Sequence
  Description of Artificial Sequence: Synthetic polypeptide
EEVEIATTNPVAYECWGCVYYGEHQINQHEEAE

SEQ ID NO: 204434 - protein, 35 aa, Artificial Sequence
  Description of Artificial Sequence: Synthetic polypeptide
DETEIRTTNPIATECWGATWANAEDWPAEPKGPPV

SEQ ID NO: 204435 - protein, 35 aa, Artificial Sequence
  Description of Artificial Sequence: Synthetic polypeptide
DETEIRTTNPIATECWGATWATAEAGPAEPKGPPV

SEQ ID NO: 204436 - protein, 37 aa, Artificial Sequence
  Description of Artificial Sequence: Synthetic polypeptide
DEECLRTTNPCAYEQYGCVCSWGEDHNAENFNSDNQS

SEQ ID NO: 204437 - protein, 37 aa, Artificial Sequence
  Description of Artificial Sequence: Synthetic polypeptide
AEEEISTTNPVAYEGYGCVCSNWEEHNAENFNSDTQS

SEQ ID NO: 204438 - protein, 38 aa, Artificial Sequence
  Description of Artificial Sequence: Synthetic polypeptide
QEDEIRTTNPVATEFYGVVYTDQQGQDQTQDEGGQGGI

SEQ ID NO: 204439 - protein, 34 aa, Artificial Sequence
  Description of Artificial Sequence: Synthetic polypeptide
DETEIRTTNPIATECWGATWSNEEDWAEPKEPYI

SEQ ID NO: 204440 - protein, 34 aa, Artificial Sequence
  Description of Artificial Sequence: Synthetic polypeptide
EEVEIATTNPVAYECWGCVYYNEHQIQQHPEEAE

SEQ ID NO: 204441 - protein, 37 aa, Artificial Sequence
  Description of Artificial Sequence: Synthetic polypeptide
AEEEISTTNPVAYEGYGCVCSNWGEHNAENFNSENQS

SEQ ID NO: 204442 - protein, 35 aa, Artificial Sequence
  Description of Artificial Sequence: Synthetic polypeptide
DETEIRTTNPIATECWGATWWANAEDWAEPKGPCI

SEQ ID NO: 204443 - protein, 35 aa, Artificial Sequence
  Description of Artificial Sequence: Synthetic polypeptide
DETEIRTTNPIATECWGATWWANAEDWAEPKGPYI

SEQ ID NO: 204444 - protein, 36 aa, Artificial Sequence
  Description of Artificial Sequence: Synthetic polypeptide
DDSEVASTNPVSTEGYGNVSAANVTIMTSRVGQDRL

SEQ ID NO: 204445 - protein, 38 aa, Artificial Sequence
  Description of Artificial Sequence: Synthetic polypeptide
DEEEIGCTNPVATEGYGCVCSNWGEDHNQENFNSDTQA

SEQ ID NO: 204446 - protein, 37 aa, Artificial Sequence
  Description of Artificial Sequence: Synthetic polypeptide
SSEEIRTTNPVAYCQYGCVCSNSGEHNQENFGSDTQA

SEQ ID NO: 204447 - protein, 39 aa, Artificial Sequence
  Description of Artificial Sequence: Synthetic polypeptide
DEEEIGCTNPVATEQYGQCVCSNWGEDHNQENFGSDTQA

SEQ ID NO: 204448 - protein, 33 aa, Artificial Sequence
  Description of Artificial Sequence: Synthetic polypeptide
EEVEIATTNPVAYECWGCAYYNEHQIQHMEEAE

SEQ ID NO: 204449 - protein, 36 aa, Artificial Sequence
  Description of Artificial Sequence: Synthetic polypeptide
DETEIRTTNPIATECWGATVWANAEDWPAEPKGPPI

SEQ ID NO: 204450 - protein, 36 aa, Artificial Sequence
  Description of Artificial Sequence: Synthetic polypeptide
DETEIRTTNPIATECWGATVWANAEDWPAEPKGPYI

SEQ ID NO: 204451 - protein, 39 aa, Artificial Sequence
  Description of Artificial Sequence: Synthetic polypeptide
DEAEIRTTNPVAYEQYGQCVCSNWGEDHNIENFNSDTQA

SEQ ID NO: 204452 - protein, 37 aa, Artificial Sequence
  Description of Artificial Sequence: Synthetic polypeptide
DEEEIGTTNPCATEGYGCCCSWGEDHNAENFGSDTQA

SEQ ID NO: 204453 - protein, 37 aa, Artificial Sequence
  Description of Artificial Sequence: Synthetic polypeptide
DEECLRTTNPCAYEQYGQCVCSNWGEHNQENFGSDQS

SEQ ID NO: 204454 - protein, 37 aa, Artificial Sequence
  Description of Artificial Sequence: Synthetic polypeptide
SSSEIRTTNPVATEQWGCYNSETIPLEEFGEEEIHED

SEQ ID NO: 204455 - protein, 34 aa, Artificial Sequence
  Description of Artificial Sequence: Synthetic polypeptide
DETEIRTTNPIATECWGATWAAAEDWAEHEGEYI

SEQ ID NO: 204456 - protein, 36 aa, Artificial Sequence
  Description of Artificial Sequence: Synthetic polypeptide
SSSEIRATNPVATEQYGACAVVALTVGHIEGEEDQE

SEQ ID NO: 204457 - protein, 35 aa, Artificial Sequence
  Description of Artificial Sequence: Synthetic polypeptide
DETEIRTTNPIATECWGATWWANAEIWAEPKGPYI

SEQ ID NO: 204458 - protein, 37 aa, Artificial Sequence
  Description of Artificial Sequence: Synthetic polypeptide
SSSEIGTTNPVATEQYGASAVVATVEFIETGTESQEW

SEQ ID NO: 204459 - protein, 35 aa, Artificial Sequence
  Description of Artificial Sequence: Synthetic polypeptide
EENEIATTNPVAYEAWGVVWPGPNNENDGQGDGEE

SEQ ID NO: 204460 - protein, 36 aa, Artificial Sequence
  Description of Artificial Sequence: Synthetic polypeptide
SSSEIATTNPVAYHSYGSVVHSEVWHSQENGGINFQ

SEQ ID NO: 204461 - protein, 38 aa, Artificial Sequence
  Description of Artificial Sequence: Synthetic polypeptide
AEAEISTTNPVATEQYGQCVCSNWGEHNAENFNSDTQS

SEQ ID NO: 204462 - protein, 38 aa, Artificial Sequence
  Description of Artificial Sequence: Synthetic polypeptide
AEAEISTTNPVATEQYGQCVCSNWGEHNAENFNSENQS

SEQ ID NO: 204463 - protein, 38 aa, Artificial Sequence
  Description of Artificial Sequence: Synthetic polypeptide
AEAEISTTNPVATEQYGQCVCSSGEDHNQENFNSDTQS

SEQ ID NO: 204464 - protein, 38 aa, Artificial Sequence
  Description of Artificial Sequence: Synthetic polypeptide
DEDEIACTNPVATAQWGHSPSATWPAQGTAQGNGMEPV

SEQ ID NO: 204465 - protein, 38 aa, Artificial Sequence
  Description of Artificial Sequence: Synthetic polypeptide
DEECISCTNPVATEGYGCVTSTWGADHNAENFNSDPQA

SEQ ID NO: 204466 - protein, 39 aa, Artificial Sequence
  Description of Artificial Sequence: Synthetic polypeptide
MEEEIATTNPVATEQYGQCVCSTWGEDDNAEGFISDTQA

SEQ ID NO: 204467 - protein, 38 aa, Artificial Sequence
  Description of Artificial Sequence: Synthetic polypeptide
SSSEIGTTNPVATEQYGASAVVATGNFIETGTEESQEE

SEQ ID NO: 204468 - protein, 40 aa, Artificial Sequence
  Description of Artificial Sequence: Synthetic polypeptide
DEEEISTTNPVATEQYGQCQVCSNWGEDHNQENFGSDTQG

SEQ ID NO: 204469 - protein, 35 aa, Artificial Sequence
  Description of Artificial Sequence: Synthetic polypeptide
DETEIRTTNPIATECWGATWWANYEDWAEPKGPYI

SEQ ID NO: 204470 - protein, 35 aa, Artificial Sequence
  Description of Artificial Sequence: Synthetic polypeptide
DETEIRTTNPIATECWGATYWANAEDWAEPKGPYI

SEQ ID NO: 204471 - protein, 35 aa, Artificial Sequence
  Description of Artificial Sequence: Synthetic polypeptide
DETEIRTTNPIATECWGCQTCGNWEDPAEYSGEYI

SEQ ID NO: 204472 - protein, 35 aa, Artificial Sequence
  Description of Artificial Sequence: Synthetic polypeptide
DETEIRTTNPIATECWGCQTCQNAEDHAEPSGEPI

SEQ ID NO: 204473 - protein, 38 aa, Artificial Sequence
  Description of Artificial Sequence: Synthetic polypeptide
AEEEIRTTNPVATEQYGIVCVVPTDTEAASSEHLLVQA

SEQ ID NO: 204474 - protein, 38 aa, Artificial Sequence
  Description of Artificial Sequence: Synthetic polypeptide
SEECIGTTNPVATEQYGCVCSNWGEDHNAENFNSDTQA

SEQ ID NO: 204475 - protein, 36 aa, Artificial Sequence
  Description of Artificial Sequence: Synthetic polypeptide
DETEIRTTNPIATECWGCQTCYNAEDPAENSGSENI

SEQ ID NO: 204476 - protein, 35 aa, Artificial Sequence
  Description of Artificial Sequence: Synthetic polypeptide
DETEIRTTNPIATECWGCTTCQNAEDHAEGSGETI

SEQ ID NO: 204477 - protein, 35 aa, Artificial Sequence
  Description of Artificial Sequence: Synthetic polypeptide
DETEIRTTNPIATECWGCTTWANAEDWAEPDGPYM

SEQ ID NO: 204478 - protein, 35 aa, Artificial Sequence
  Description of Artificial Sequence: Synthetic polypeptide
DETEIRTTNPIATECWGCTTWANAEDWAEPKGFYI

SEQ ID NO: 204479 - protein, 35 aa, Artificial Sequence
  Description of Artificial Sequence: Synthetic polypeptide
DETEIRTTNPIATECWGCTTWANAEDWAEPKGPYI

SEQ ID NO: 204480 - protein, 36 aa, Artificial Sequence
  Description of Artificial Sequence: Synthetic polypeptide
EEGEIRCTNPTAYEQWGSTVYGEVNDDHQGGDGKTH

SEQ ID NO: 204481 - protein, 40 aa, Artificial Sequence
  Description of Artificial Sequence: Synthetic polypeptide
AEEEIRTTNPVATEQYGQCAVCSNWGEDHNAENFNSDTQS

SEQ ID NO: 204482 - protein, 36 aa, Artificial Sequence
  Description of Artificial Sequence: Synthetic polypeptide
DETEIRTTNPIATECWGEATTWANAEDWAEPKGPYI

SEQ ID NO: 204483 - protein, 40 aa, Artificial Sequence
  Description of Artificial Sequence: Synthetic polypeptide
AEEEIRTTNPVATEQYGQCQVCSNWEEDHEQENFNSDTQA

SEQ ID NO: 204484 - protein, 39 aa, Artificial Sequence
  Description of Artificial Sequence: Synthetic polypeptide
AEEEIRTTNPVATEQYGQCVCGNWGEDHNAENFNSDNQA

SEQ ID NO: 204485 - protein, 35 aa, Artificial Sequence
  Description of Artificial Sequence: Synthetic polypeptide
QEEEIACTNPVAYEQWGSACADGALANTGGVMQMD

SEQ ID NO: 204486 - protein, 39 aa, Artificial Sequence
  Description of Artificial Sequence: Synthetic polypeptide
AEEEIRTTNPVATEQYGQCVCSNSGEDHDAENFGSETQS

SEQ ID NO: 204487 - protein, 37 aa, Artificial Sequence
  Description of Artificial Sequence: Synthetic polypeptide
DEECLRTTNPCAYEQYGCVCSTWGEHNQENFISDTQA

SEQ ID NO: 204488 - protein, 35 aa, Artificial Sequence
  Description of Artificial Sequence: Synthetic polypeptide
DETEIRTTNPIATECWGCQTCANWEDPAENSGETI

SEQ ID NO: 204489 - protein, 35 aa, Artificial Sequence
  Description of Artificial Sequence: Synthetic polypeptide
DETEIRTTNPIATECWGCQTCANAEEHAEYSGEPI

SEQ ID NO: 204490 - protein, 36 aa, Artificial Sequence
  Description of Artificial Sequence: Synthetic polypeptide
DETEIRTTNPIATECWGCHTTWANAEDWAEPKGPYI

SEQ ID NO: 204491 - protein, 38 aa, Artificial Sequence
  Description of Artificial Sequence: Synthetic polypeptide
SEECICCTNPVATEQYGCSVYIQTYAEEQEEGEFSLQS

SEQ ID NO: 204492 - protein, 35 aa, Artificial Sequence
  Description of Artificial Sequence: Synthetic polypeptide
DETEIRTTNPIATECWGATYWANVEDHHEPKGDHI

SEQ ID NO: 204493 - protein, 35 aa, Artificial Sequence
  Description of Artificial Sequence: Synthetic polypeptide
DETEIRTTNPIATECWGATYWDNVEDIHEPKGDQH

SEQ ID NO: 204494 - protein, 35 aa, Artificial Sequence
  Description of Artificial Sequence: Synthetic polypeptide
DETEIRTTNPIATECWGATYWPNAEDHMEPKGDYH

SEQ ID NO: 204495 - protein, 35 aa, Artificial Sequence
  Description of Artificial Sequence: Synthetic polypeptide
DETEIRTTNPIATECWGATYWPNAEDWAENKGDDH

SEQ ID NO: 204496 - protein, 35 aa, Artificial Sequence
  Description of Artificial Sequence: Synthetic polypeptide
DETEIRTTNPIATECWGATYYANVADWAEPKGPDI

SEQ ID NO: 204497 - protein, 35 aa, Artificial Sequence
  Description of Artificial Sequence: Synthetic polypeptide
DETEIRTTNPIATECWGATYYANVEDHAEKKGESS

SEQ ID NO: 204498 - protein, 35 aa, Artificial Sequence
  Description of Artificial Sequence: Synthetic polypeptide
DETEIRTTNPIATECWGATYYANVEDHAEKKGPMQ

SEQ ID NO: 204499 - protein, 35 aa, Artificial Sequence
  Description of Artificial Sequence: Synthetic polypeptide
DETEIRTTNPIATECWGAVTWAWAEDWAEPKGPYI

SEQ ID NO: 204500 - protein, 35 aa, Artificial Sequence
  Description of Artificial Sequence: Synthetic polypeptide
DETEIRTTNPIATECWGATYWANAEDWAEPKGDIH

SEQ ID NO: 204501 - protein, 33 aa, Artificial Sequence
  Description of Artificial Sequence: Synthetic polypeptide
EEVEIATTNPVAYECWGTVYYVEDEHQHEEKDE

SEQ ID NO: 204502 - protein, 35 aa, Artificial Sequence
  Description of Artificial Sequence: Synthetic polypeptide
DETEIRTTNPIATECWGAYTRANAEDWAEPKGPYI

SEQ ID NO: 204503 - protein, 34 aa, Artificial Sequence
  Description of Artificial Sequence: Synthetic polypeptide
EEVEIATTNPVAYECWGTVYYVENDSHQHEEEGD

SEQ ID NO: 204504 - protein, 35 aa, Artificial Sequence
  Description of Artificial Sequence: Synthetic polypeptide
DETEIRTTNPIATECWGAYTWANAEDWAEPKGPYI

SEQ ID NO: 204505 - protein, 39 aa, Artificial Sequence
  Description of Artificial Sequence: Synthetic polypeptide
CEEEISTTNPVATEQYGQCVCSNWGEDHNQENFISDNQE

SEQ ID NO: 204506 - protein, 39 aa, Artificial Sequence
  Description of Artificial Sequence: Synthetic polypeptide
CEEEISTTNPVATEQYGQCVCSNWGEDHNTEYFFSDNQS

SEQ ID NO: 204507 - protein, 36 aa, Artificial Sequence
  Description of Artificial Sequence: Synthetic polypeptide
DETEIRTTNPIATECWGCATTWANAEDWAEPKGPYI

SEQ ID NO: 204508 - protein, 35 aa, Artificial Sequence
  Description of Artificial Sequence: Synthetic polypeptide
EEHEIATTNPVAYECWGTVYWINENQDRQMIHAGS

SEQ ID NO: 204509 - protein, 36 aa, Artificial Sequence
  Description of Artificial Sequence: Synthetic polypeptide
DETEIRTTNPIATECWGCATTWANAEEWAEPKGPYI

SEQ ID NO: 204510 - protein, 35 aa, Artificial Sequence
  Description of Artificial Sequence: Synthetic polypeptide
EEMAIATTNAVATEQYGTVCNATDMEVEFEVNTDT

SEQ ID NO: 204511 - protein, 39 aa, Artificial Sequence
  Description of Artificial Sequence: Synthetic polypeptide
DEEEISTTNPVATEQYGQCTCSNWGEDHNAENFNSDTQS

SEQ ID NO: 204512 - protein, 35 aa, Artificial Sequence
  Description of Artificial Sequence: Synthetic polypeptide
DETEIRTTNPIATERWGATEWANAEDWAEPKGPYI

SEQ ID NO: 204513 - protein, 37 aa, Artificial Sequence
  Description of Artificial Sequence: Synthetic polypeptide
DDMEIATTNPVAYEQYGCVCSNWMEHNEEHFGSETQA

SEQ ID NO: 204514 - protein, 36 aa, Artificial Sequence
  Description of Artificial Sequence: Synthetic polypeptide
DEAEIRTTNPVSYEPWGWKISCMGDSISVNMNGGPF

SEQ ID NO: 204515 - protein, 38 aa, Artificial Sequence
  Description of Artificial Sequence: Synthetic polypeptide
SENEISTTNPVATEQYGQCVCSNSGEHNQENFNSDNQM

SEQ ID NO: 204516 - protein, 38 aa, Artificial Sequence
  Description of Artificial Sequence: Synthetic polypeptide
IEGEIRTTNPVATEQYGSSWAYPDKTFFVSDDFEDFYE

SEQ ID NO: 204517 - protein, 36 aa, Artificial Sequence
  Description of Artificial Sequence: Synthetic polypeptide
DEAEIRTTNPVSYEPWGKIQSCMEDSISDQMNGGPF

SEQ ID NO: 204518 - protein, 39 aa, Artificial Sequence
  Description of Artificial Sequence: Synthetic polypeptide
DEAEIRTTNPVSTEQYGQCVCGNWGEDDNQEGFISQTQS

SEQ ID NO: 204519 - protein, 38 aa, Artificial Sequence
  Description of Artificial Sequence: Synthetic polypeptide
SENESEIRTTNPVAYEPWGVCAFTGDNDRPGERQGNGA

SEQ ID NO: 204520 - protein, 38 aa, Artificial Sequence
  Description of Artificial Sequence: Synthetic polypeptide
DEECIRTTNPVAYEGYGCVCSNWGEDHNQEYFNSDTQS

SEQ ID NO: 204521 - protein, 39 aa, Artificial Sequence
  Description of Artificial Sequence: Synthetic polypeptide
DAAEIATTNPVATEQYGSTACAMANPAEGLNHQDGMQMN

SEQ ID NO: 204522 - protein, 37 aa, Artificial Sequence
  Description of Artificial Sequence: Synthetic polypeptide
DEAEISTTNPVATEGYGCVCFNWGEHNTENFSSDTQS

SEQ ID NO: 204523 - protein, 38 aa, Artificial Sequence
  Description of Artificial Sequence: Synthetic polypeptide
DEAEISTTNPVATEGYGCVCSMWGEDHNAENFNSDNQA

SEQ ID NO: 204524 - protein, 39 aa, Artificial Sequence
  Description of Artificial Sequence: Synthetic polypeptide
DEECIRTTNPVAYEGYGQCVTSTWGADHNAENFNSDPQA

SEQ ID NO: 204525 - protein, 38 aa, Artificial Sequence
  Description of Artificial Sequence: Synthetic polypeptide
DEAEISTTNPVATEGYGCVCSNWGEDHNAENFNSDTQL

SEQ ID NO: 204526 - protein, 37 aa, Artificial Sequence
  Description of Artificial Sequence: Synthetic polypeptide
QAPEIATTNPVAYAPWGSTVASGTGNPQNGNPTEGAW

SEQ ID NO: 204527 - protein, 38 aa, Artificial Sequence
  Description of Artificial Sequence: Synthetic polypeptide
DEAEISTTNPVATEGYGCVCSNWGEDHNIENFNSDTQS

SEQ ID NO: 204528 - protein, 38 aa, Artificial Sequence
  Description of Artificial Sequence: Synthetic polypeptide
AEMCIATTNPVATEQYGQCVCSNWGEHNAEHFGSENQA

SEQ ID NO: 204529 - protein, 38 aa, Artificial Sequence
  Description of Artificial Sequence: Synthetic polypeptide
DEDEIRTTNPVATEQWGCCNAGAGAHPGDLHPDDSANR

SEQ ID NO: 204530 - protein, 37 aa, Artificial Sequence
  Description of Artificial Sequence: Synthetic polypeptide
DDECISCTNPVATEQYGCVCSNWGEDNQENFNSDTQS

SEQ ID NO: 204531 - protein, 37 aa, Artificial Sequence
  Description of Artificial Sequence: Synthetic polypeptide
SEPEIRTTNPVATEQWGAIAVVAWPVHQLEGQEDQEY

SEQ ID NO: 204532 - protein, 38 aa, Artificial Sequence
  Description of Artificial Sequence: Synthetic polypeptide
SEPEIRTTNPVATEQWGASAVVAWFVHHLEGQEADQEY

SEQ ID NO: 204533 - protein, 37 aa, Artificial Sequence
  Description of Artificial Sequence: Synthetic polypeptide
DEDEIRTTNPVATEQWGCCNAGAGAHPGDNHPDDSNW

SEQ ID NO: 204534 - protein, 38 aa, Artificial Sequence
  Description of Artificial Sequence: Synthetic polypeptide
DEAEIRTTNPVATEGWGCVCSNWGEDENQEYFGSDTQG

SEQ ID NO: 204535 - protein, 34 aa, Artificial Sequence
  Description of Artificial Sequence: Synthetic polypeptide
SEQEIATTNPVATAQWGTNCAATDGHPMEFEIND

SEQ ID NO: 204536 - protein, 39 aa, Artificial Sequence
  Description of Artificial Sequence: Synthetic polypeptide
DEECISTTNPVAYEQYGQCVCSNWGEDHNAENFQSDNQS

SEQ ID NO: 204537 - protein, 37 aa, Artificial Sequence
  Description of Artificial Sequence: Synthetic polypeptide
DEDEIRTTNPVATEQWGCCALAGAHPGDLHPDDSQNW

SEQ ID NO: 204538 - protein, 37 aa, Artificial Sequence
  Description of Artificial Sequence: Synthetic polypeptide
EGEEIATTNPVAYEQWGVVCYQVTPNEHNQRDDTDGE

SEQ ID NO: 204539 - protein, 39 aa, Artificial Sequence
  Description of Artificial Sequence: Synthetic polypeptide
DEMCIRTTNPVATEQYGQCVTQTWGADDNAEYFNSDPQS

SEQ ID NO: 204540 - protein, 37 aa, Artificial Sequence
  Description of Artificial Sequence: Synthetic polypeptide
DDECIRTTNPVGTEQWGQCVCSWGEDNAENFGSDTQS

SEQ ID NO: 204541 - protein, 37 aa, Artificial Sequence
  Description of Artificial Sequence: Synthetic polypeptide
SEAEIRCTNPVATEQYGCVCEWGEDHNQEHFNSDTQS

SEQ ID NO: 204542 - protein, 37 aa, Artificial Sequence
  Description of Artificial Sequence: Synthetic polypeptide
DAAEIATTNPVATEQYGCVAAGPNPAPEAGTPMEDHG

SEQ ID NO: 204543 - protein, 37 aa, Artificial Sequence
  Description of Artificial Sequence: Synthetic polypeptide
SEAEIRCTNPVATEQYGCVCEWGELHNAEHFNSDTQA

SEQ ID NO: 204544 - protein, 39 aa, Artificial Sequence
  Description of Artificial Sequence: Synthetic polypeptide
DEEEIATVNPVATEQYGQCVCSNWMEDHNAENFNSQTQS

SEQ ID NO: 204545 - protein, 34 aa, Artificial Sequence
  Description of Artificial Sequence: Synthetic polypeptide
EGTEIATTNPVAYEQWGVVYTWPGEESQNQSEGM

SEQ ID NO: 204546 - protein, 39 aa, Artificial Sequence
  Description of Artificial Sequence: Synthetic polypeptide
IEGEIATTNPVATEQYGNISFSAPDDTHREPHEKQEDTR

SEQ ID NO: 204547 - protein, 38 aa, Artificial Sequence
  Description of Artificial Sequence: Synthetic polypeptide
ADEEIRTTNPVAYEQYGQCVCSNWGEHNAENFNSDTQL

SEQ ID NO: 204548 - protein, 39 aa, Artificial Sequence
  Description of Artificial Sequence: Synthetic polypeptide
SENEIRTTNPVATEQYGTVYNDYTLMGMHQQEILQDDTQ

SEQ ID NO: 204549 - protein, 37 aa, Artificial Sequence
  Description of Artificial Sequence: Synthetic polypeptide
DDECIRTTNPVAYEQWGCVTSNWGEHNAENFNSDTAS

SEQ ID NO: 204550 - protein, 38 aa, Artificial Sequence
  Description of Artificial Sequence: Synthetic polypeptide
AEREIRTTNPVAYEQYGQCVCSNWGEHNAENFNSENQS

SEQ ID NO: 204551 - protein, 38 aa, Artificial Sequence
  Description of Artificial Sequence: Synthetic polypeptide
DDECIRTTNPVAYEQYGCVCSNWGEDHNAENFNSDTQS

SEQ ID NO: 204552 - protein, 38 aa, Artificial Sequence
  Description of Artificial Sequence: Synthetic polypeptide
AEREISTTNPVATEQYGCVCSNWGEDHNAENFNSDTQS

SEQ ID NO: 204553 - protein, 38 aa, Artificial Sequence
  Description of Artificial Sequence: Synthetic polypeptide
DEAEIACTNPVATEQYGSVYANAEAAPEAGMPQDEDAM

SEQ ID NO: 204554 - protein, 38 aa, Artificial Sequence
  Description of Artificial Sequence: Synthetic polypeptide
DEAEISTTNPVATEGWGCVCSTWGEDENAEYFGSDTQA

SEQ ID NO: 204555 - protein, 39 aa, Artificial Sequence
  Description of Artificial Sequence: Synthetic polypeptide
DEEEISTTNPVATEQYGQCVCSNWGEDDNAENFISETQS

SEQ ID NO: 204556 - protein, 38 aa, Artificial Sequence
  Description of Artificial Sequence: Synthetic polypeptide
DEAEIACTNPVAYEQWGSACAATNPAEEAGRHGDNAAP

SEQ ID NO: 204557 - protein, 36 aa, Artificial Sequence
  Description of Artificial Sequence: Synthetic polypeptide
DEAEIACTNPVAYEQYGSCAAAGGHHGNAEGGGQVN

SEQ ID NO: 204558 - protein, 38 aa, Artificial Sequence
  Description of Artificial Sequence: Synthetic polypeptide
DDEEISTTNPVATEGYGQCVCSMWGEDNQENFNSDTQS

SEQ ID NO: 204559 - protein, 37 aa, Artificial Sequence
  Description of Artificial Sequence: Synthetic polypeptide
SENEIACTNPVATEQYGCSCSNWGEDNAEYFISDNQA

SEQ ID NO: 204560 - protein, 37 aa, Artificial Sequence
  Description of Artificial Sequence: Synthetic polypeptide
HEGHIRCTNPVATEQYGEVCKPDYDSLPEFRDDTNSQ

SEQ ID NO: 204561 - protein, 37 aa, Artificial Sequence
  Description of Artificial Sequence: Synthetic polypeptide
DEDEIRTTNPVATEQWGCCAGAGAHPGTLHPDDSPNN

SEQ ID NO: 204562 - protein, 35 aa, Artificial Sequence
  Description of Artificial Sequence: Synthetic polypeptide
QEGVIAPTNPCSYEQYGVTVSCCNMLSDSNGGTLR

SEQ ID NO: 204563 - protein, 37 aa, Artificial Sequence
  Description of Artificial Sequence: Synthetic polypeptide
DEDEIRTTNPVATEQWGCCAGAGEHPGDLHPDDSSNN

SEQ ID NO: 204564 - protein, 36 aa, Artificial Sequence
  Description of Artificial Sequence: Synthetic polypeptide
DEGEIATTNPVATAQWGCNVAGEGEIMNAALMDNHM

SEQ ID NO: 204565 - protein, 39 aa, Artificial Sequence
  Description of Artificial Sequence: Synthetic polypeptide
DEEEISTTNPVATEQYGQCVCSMWGEDHNAENFISDTQS

SEQ ID NO: 204566 - protein, 34 aa, Artificial Sequence
  Description of Artificial Sequence: Synthetic polypeptide
AEEVIASTNPCATQEYGCICCCNEASTRPGGKNV

SEQ ID NO: 204567 - protein, 36 aa, Artificial Sequence
  Description of Artificial Sequence: Synthetic polypeptide
SEAEIRTTNPVATEIYWQSFKTWDEGETTSFEGSQF

SEQ ID NO: 204568 - protein, 39 aa, Artificial Sequence
  Description of Artificial Sequence: Synthetic polypeptide
DENEIRTTNPVATEQWGAVNVINGEEGEEMNAGEGDGEQ

SEQ ID NO: 204569 - protein, 38 aa, Artificial Sequence
  Description of Artificial Sequence: Synthetic polypeptide
DDECISTTNPVATEQYGQCVCSNWGEHNAEFFNSDTQG

SEQ ID NO: 204570 - protein, 38 aa, Artificial Sequence
  Description of Artificial Sequence: Synthetic polypeptide
EEAEIRTTNPVAYEQWGVVCSGGGNMAGNDRQTDDSGT

SEQ ID NO: 204571 - protein, 36 aa, Artificial Sequence
  Description of Artificial Sequence: Synthetic polypeptide
DAEEIATTNPVAYEQWGCNTAGNNGLTTAEGGMLDS

SEQ ID NO: 204572 - protein, 37 aa, Artificial Sequence
  Description of Artificial Sequence: Synthetic polypeptide
DEMCIRTTNPCATEQWGCVCSWGEDHNQESFGSDTQA

SEQ ID NO: 204573 - protein, 38 aa, Artificial Sequence
  Description of Artificial Sequence: Synthetic polypeptide
DEGEIATTNPVATAQWGHSASAVGDPLEADTPGGENNH

SEQ ID NO: 204574 - protein, 35 aa, Artificial Sequence
  Description of Artificial Sequence: Synthetic polypeptide
AEAEIASTNPVGYEAYGVVMPAYSPGLSQHVGDIE

SEQ ID NO: 204575 - protein, 38 aa, Artificial Sequence
  Description of Artificial Sequence: Synthetic polypeptide
DEINEIATTNPVAYEAWGEVCSTPNQGNHGEAGGDGRN

SEQ ID NO: 204576 - protein, 38 aa, Artificial Sequence
  Description of Artificial Sequence: Synthetic polypeptide
DENEIRTTNPVATEQFGACVCWVADVDVEQLEGGEDHL

SEQ ID NO: 204577 - protein, 38 aa, Artificial Sequence
  Description of Artificial Sequence: Synthetic polypeptide
DDEEISTTNPVATCQYGCVCSNWGEGDNAENFNSDTQA

SEQ ID NO: 204578 - protein, 35 aa, Artificial Sequence
  Description of Artificial Sequence: Synthetic polypeptide
DELEIRTTNPIATECWGCTTWANAEDWAEPKGPYI

SEQ ID NO: 204579 - protein, 36 aa, Artificial Sequence
  Description of Artificial Sequence: Synthetic polypeptide
EEAEIATVNPVAYEQWGCVTGNNNEGEQDRQGEGSQ

SEQ ID NO: 204580 - protein, 36 aa, Artificial Sequence
  Description of Artificial Sequence: Synthetic polypeptide
EEAEIATVNPVAYEQWGCVTGNGNEGEQDIQGESGR

SEQ ID NO: 204581 - protein, 37 aa, Artificial Sequence
  Description of Artificial Sequence: Synthetic polypeptide
DEAEIRTTNPVATEQWGCCAGAGAHPGDLHPDDSANN

SEQ ID NO: 204582 - protein, 37 aa, Artificial Sequence
  Description of Artificial Sequence: Synthetic polypeptide
DEGEIATTNPVATAQWGHSASAVGHPEADTPGIEDNV

SEQ ID NO: 204583 - protein, 36 aa, Artificial Sequence
  Description of Artificial Sequence: Synthetic polypeptide
EEAEIATTNPVAYEQWGHYTIQPNEGDQQQEGDERE

SEQ ID NO: 204584 - protein, 39 aa, Artificial Sequence
  Description of Artificial Sequence: Synthetic polypeptide
SEAEIRTTNPVATEQYGICHECPDDNNNEEHRYGDNQQQ

SEQ ID NO: 204585 - protein, 39 aa, Artificial Sequence
  Description of Artificial Sequence: Synthetic polypeptide
DEEEIRGTNPVATEQWGQVNVDDNENFDQHEGEGQGETG

SEQ ID NO: 204586 - protein, 37 aa, Artificial Sequence
  Description of Artificial Sequence: Synthetic polypeptide
DEGEIATTNPVATAQWGHVVAANTGHGEYGAEEDGNT

SEQ ID NO: 204587 - protein, 38 aa, Artificial Sequence
  Description of Artificial Sequence: Synthetic polypeptide
SEAEIATTNPVATEQYGCVCSVWGEDHNAEGFISDNQA

SEQ ID NO: 204588 - protein, 37 aa, Artificial Sequence
  Description of Artificial Sequence: Synthetic polypeptide
DEEEIRTTNPSAYHAYGEVVACWLPSSSTITTPGSTG

SEQ ID NO: 204589 - protein, 35 aa, Artificial Sequence
  Description of Artificial Sequence: Synthetic polypeptide
DETEIRTTNPVATECWGATTWANAEIWAEPAEPYI

SEQ ID NO: 204590 - protein, 36 aa, Artificial Sequence
  Description of Artificial Sequence: Synthetic polypeptide
SEREISCTNPVATEQYGCVCEWGEHNAEHFGSDTQS

SEQ ID NO: 204591 - protein, 38 aa, Artificial Sequence
  Description of Artificial Sequence: Synthetic polypeptide
SEAEIRTTNPVATEQYGCVCGNWGADHNQENFMSDTQA

SEQ ID NO: 204592 - protein, 39 aa, Artificial Sequence
  Description of Artificial Sequence: Synthetic polypeptide
DEEEISTTNPVATEQYGQCVCSNWGEDHDAEFFGSDTQA

SEQ ID NO: 204593 - protein, 39 aa, Artificial Sequence
  Description of Artificial Sequence: Synthetic polypeptide
DEEEISTTNPVATEQYGQCVCPNWGEDDNAENFNSDTQS

SEQ ID NO: 204594 - protein, 39 aa, Artificial Sequence
  Description of Artificial Sequence: Synthetic polypeptide
DEEEISTTNPVATEQYGQCVCPNWGEDHNAENFNSETQA

SEQ ID NO: 204595 - protein, 38 aa, Artificial Sequence
  Description of Artificial Sequence: Synthetic polypeptide
DENEIRTTNPVATEQWGCVCSNSGEDENAENSSSDTQA

SEQ ID NO: 204596 - protein, 35 aa, Artificial Sequence
  Description of Artificial Sequence: Synthetic polypeptide
DETEIRTTNPVATECWGATWACIDWPAEPEGEPYI

SEQ ID NO: 204597 - protein, 35 aa, Artificial Sequence
  Description of Artificial Sequence: Synthetic polypeptide
DETEIRTTNPVATECWGATWACIDWPADPEGEPYI

SEQ ID NO: 204598 - protein, 35 aa, Artificial Sequence
  Description of Artificial Sequence: Synthetic polypeptide
DETEIRTTNPVATECWGATWACIDWPADPEGEPYG

SEQ ID NO: 204599 - protein, 38 aa, Artificial Sequence
  Description of Artificial Sequence: Synthetic polypeptide
DEGEIATTNPVATAQWGHSAASAVGDLEADTPPGEDNP

SEQ ID NO: 204600 - protein, 37 aa, Artificial Sequence
  Description of Artificial Sequence: Synthetic polypeptide
CEEEIACTNPVATEQWGSVVACPEGPPAGEGMGMNMN

SEQ ID NO: 204601 - protein, 38 aa, Artificial Sequence
  Description of Artificial Sequence: Synthetic polypeptide
DEGEIATTNPVATAQWGHSASAVGDDLEADTPPGEDNM

SEQ ID NO: 204602 - protein, 39 aa, Artificial Sequence
  Description of Artificial Sequence: Synthetic polypeptide
DEEEISTTNPVATEQYGQCVCQNWGEDHNEESFNSDTQA

SEQ ID NO: 204603 - protein, 39 aa, Artificial Sequence
  Description of Artificial Sequence: Synthetic polypeptide
DEMCIRTTNPVATEQYGQCVCSNWGEDDNAEFFNSDNQS

SEQ ID NO: 204604 - protein, 39 aa, Artificial Sequence
  Description of Artificial Sequence: Synthetic polypeptide
DENEIRTTNPVATEQWGAVVDNSEEGEEGMNAGEGDGGG

SEQ ID NO: 204605 - protein, 39 aa, Artificial Sequence
  Description of Artificial Sequence: Synthetic polypeptide
DEEEISTTNPVATEQYGQCVCQNWGEDHNAEYFNSETQS

SEQ ID NO: 204606 - protein, 39 aa, Artificial Sequence
  Description of Artificial Sequence: Synthetic polypeptide
DEEEISTTNPVATEQYGQCVCQNWGEDHNAENSNSDNQS

SEQ ID NO: 204607 - protein, 39 aa, Artificial Sequence
  Description of Artificial Sequence: Synthetic polypeptide
DEEEISTTNPVATEQYGQCVCQNWGEDHNAENFNSQTQA

SEQ ID NO: 204608 - protein, 39 aa, Artificial Sequence
  Description of Artificial Sequence: Synthetic polypeptide
DEEEISTTNPVATEQYGQCVCQNWGEDHNAENFISDFQP

SEQ ID NO: 204609 - protein, 37 aa, Artificial Sequence
  Description of Artificial Sequence: Synthetic polypeptide
DEEEIATTNPVAYGQYGCTIPNPNVVPQEASINEQTS

SEQ ID NO: 204610 - protein, 35 aa, Artificial Sequence
  Description of Artificial Sequence: Synthetic polypeptide
EECEIRCTNPTAYEQWGSTVYGEWDDHQGGDGKTH

SEQ ID NO: 204611 - protein, 38 aa, Artificial Sequence
  Description of Artificial Sequence: Synthetic polypeptide
DEEVIACTNPVAYEQWGSVICAASLNHGQDHAGPYALM

SEQ ID NO: 204612 - protein, 39 aa, Artificial Sequence
  Description of Artificial Sequence: Synthetic polypeptide
DEEEISTTNPVATEQYGQCVCQNWGEDHNAENFGSDTQS

SEQ ID NO: 204613 - protein, 39 aa, Artificial Sequence
  Description of Artificial Sequence: Synthetic polypeptide
DEEEISTTNPVATEQYGQCVCQNWGEDHDQEFFPSDTQS

SEQ ID NO: 204614 - protein, 38 aa, Artificial Sequence
  Description of Artificial Sequence: Synthetic polypeptide
DDEEIATTNPVATEQYGCSCSNWPEDHNAENFDSDTQS

SEQ ID NO: 204615 - protein, 37 aa, Artificial Sequence
  Description of Artificial Sequence: Synthetic polypeptide
DEGEIATTNPVATAQWGHSASAVGDPEADTPGGEDNN

SEQ ID NO: 204616 - protein, 39 aa, Artificial Sequence
  Description of Artificial Sequence: Synthetic polypeptide
DENEIRTTNPVATEQWGAVVDNGEEGEEEMNAGEGDGTA

SEQ ID NO: 204617 - protein, 37 aa, Artificial Sequence
  Description of Artificial Sequence: Synthetic polypeptide
DEGEIATTNPVATAQWGHSASAVGDPLEADAPGGEDN

SEQ ID NO: 204618 - protein, 38 aa, Artificial Sequence
  Description of Artificial Sequence: Synthetic polypeptide
DEESIRTTNPVAYEPYYQGVNSNTRVDLLGPRSIEKHA

SEQ ID NO: 204619 - protein, 38 aa, Artificial Sequence
  Description of Artificial Sequence: Synthetic polypeptide
DDEEISTTNPVATCQYGCVCSNWGEAPNAEHFNSDNQA

SEQ ID NO: 204620 - protein, 38 aa, Artificial Sequence
  Description of Artificial Sequence: Synthetic polypeptide
DDEEISTTNPVATCQYGQCVCSNWGEPNAEYFGSETQS

SEQ ID NO: 204621 - protein, 36 aa, Artificial Sequence
  Description of Artificial Sequence: Synthetic polypeptide
EIAEIATTNPVAYEQWGSCVTWDTPEGDQKHGRTDK

SEQ ID NO: 204622 - protein, 39 aa, Artificial Sequence
  Description of Artificial Sequence: Synthetic polypeptide
DEEEISTTNPVATEQYGQCVCENWGEDHNAENFNSDTQA

SEQ ID NO: 204623 - protein, 35 aa, Artificial Sequence
  Description of Artificial Sequence: Synthetic polypeptide
DDSEVASTNPVSTEGYGNVAANSTWYQSDVGQTFL

SEQ ID NO: 204624 - protein, 36 aa, Artificial Sequence
  Description of Artificial Sequence: Synthetic polypeptide
QEDEIRGTNPVATEAWGGCNSAINGEGQDGQGGQGD

SEQ ID NO: 204625 - protein, 37 aa, Artificial Sequence
  Description of Artificial Sequence: Synthetic polypeptide
SEEEIATTNPVATEQYGCFCGNWGEDNQEHFSSETQS

SEQ ID NO: 204626 - protein, 40 aa, Artificial Sequence
  Description of Artificial Sequence: Synthetic polypeptide
DEEEIRTTNPVATLQYGTVAARSFELANIIEKTSGAQWYE

SEQ ID NO: 204627 - protein, 37 aa, Artificial Sequence
  Description of Artificial Sequence: Synthetic polypeptide
DEEVEIATTNPVAYEAWGVVWPGPNNENDKGQQGDSE

SEQ ID NO: 204628 - protein, 37 aa, Artificial Sequence
  Description of Artificial Sequence: Synthetic polypeptide
DEAEISTTNPEATEQYGCVCGNWGEDNAEYFNSDTQS

SEQ ID NO: 204629 - protein, 38 aa, Artificial Sequence
  Description of Artificial Sequence: Synthetic polypeptide
AENEISTTNPVATEQYGQCVCSNWGEHNQEFFGSDTQS

SEQ ID NO: 204630 - protein, 37 aa, Artificial Sequence
  Description of Artificial Sequence: Synthetic polypeptide
SEEEIATTNPVATEQWGTNVCAAGAWTQEHQDDEQAA

SEQ ID NO: 204631 - protein, 36 aa, Artificial Sequence
  Description of Artificial Sequence: Synthetic polypeptide
SEEEIATTNPVATEQWGTNVCAAGAPQEHQDDEQKA

SEQ ID NO: 204632 - protein, 34 aa, Artificial Sequence
  Description of Artificial Sequence: Synthetic polypeptide
AEQEIAATNPVGTEAWGVCAPTERDQHQGQDDTR

SEQ ID NO: 204633 - protein, 35 aa, Artificial Sequence
  Description of Artificial Sequence: Synthetic polypeptide
AEAEIATTNPVATEQYGCFCPWGEDNQEHFSSEQS

SEQ ID NO: 204634 - protein, 38 aa, Artificial Sequence
  Description of Artificial Sequence: Synthetic polypeptide
DAAEIACTNPVATEQYGCNVAAITNGLEAGADIDDADG

SEQ ID NO: 204635 - protein, 37 aa, Artificial Sequence
  Description of Artificial Sequence: Synthetic polypeptide
SENEIATTNPVATEGYGCVCSWGEDHNAEYFISENQA

SEQ ID NO: 204636 - protein, 35 aa, Artificial Sequence
  Description of Artificial Sequence: Synthetic polypeptide
QEDEIRGTNPVATEAWGNCAAINGEGQDGQGGQGD

SEQ ID NO: 204637 - protein, 32 aa, Artificial Sequence
  Description of Artificial Sequence: Synthetic polypeptide
QESEIATTNPIATECWGATTWAADWAEPGPYI

SEQ ID NO: 204638 - protein, 32 aa, Artificial Sequence
  Description of Artificial Sequence: Synthetic polypeptide
QESEIATTNPIATECWGATMWAAEDWAPKGPI

SEQ ID NO: 204639 - protein, 36 aa, Artificial Sequence
  Description of Artificial Sequence: Synthetic polypeptide
DEATEIATTNPVAYEHWGVVWPGPNNENDGQDNGSE

SEQ ID NO: 204640 - protein, 38 aa, Artificial Sequence
  Description of Artificial Sequence: Synthetic polypeptide
DDECIRTTNPVATEQYGQCVCSWGEGHNQENFISDTQS

SEQ ID NO: 204641 - protein, 34 aa, Artificial Sequence
  Description of Artificial Sequence: Synthetic polypeptide
AEHEIASTNPVGYEAYGVVHAYSGLSQNHVGDQI

SEQ ID NO: 204642 - protein, 39 aa, Artificial Sequence
  Description of Artificial Sequence: Synthetic polypeptide
DEEEISTTNPVATEQYGQCVCSNSGEEHNQENFISDTQA

SEQ ID NO: 204643 - protein, 39 aa, Artificial Sequence
  Description of Artificial Sequence: Synthetic polypeptide
DEMEIVTTNPVATEQYGQCVCSNWGEDPNEENFGSDTQS

SEQ ID NO: 204644 - protein, 39 aa, Artificial Sequence
  Description of Artificial Sequence: Synthetic polypeptide
AENEISTTNPVATEQYGQCVCSNSGEDHNQEGFGSDNQS

SEQ ID NO: 204645 - protein, 38 aa, Artificial Sequence
  Description of Artificial Sequence: Synthetic polypeptide
DENEIRGTNPVATEQYGVAYGNNGGEGGGQAGDTGGSG

SEQ ID NO: 204646 - protein, 37 aa, Artificial Sequence
  Description of Artificial Sequence: Synthetic polypeptide
DEAEIATTNPVAYERWGSVACQPPNEEQGEQMGMDQS

SEQ ID NO: 204647 - protein, 36 aa, Artificial Sequence
  Description of Artificial Sequence: Synthetic polypeptide
SENEIATTNPVATEGYGQCVCSNWEDNQHFISETQA

SEQ ID NO: 204648 - protein, 37 aa, Artificial Sequence
  Description of Artificial Sequence: Synthetic polypeptide
CEEEIACTNPVATEQYGSACAANPAEGQDHQDDELAK

SEQ ID NO: 204649 - protein, 38 aa, Artificial Sequence
  Description of Artificial Sequence: Synthetic polypeptide
SEEEIATTNPVATEQYGQCSCGTWGEDNQEHFSSETQA

SEQ ID NO: 204650 - protein, 36 aa, Artificial Sequence
  Description of Artificial Sequence: Synthetic polypeptide
DEAEISTTNPCATEGYGCCCSWGEHNAENFGSDTQA

SEQ ID NO: 204651 - protein, 38 aa, Artificial Sequence
  Description of Artificial Sequence: Synthetic polypeptide
SEEEIATTNPVATEQYGQCQSCGNWGEDNAHFISETQS

SEQ ID NO: 204652 - protein, 35 aa, Artificial Sequence
  Description of Artificial Sequence: Synthetic polypeptide
HESEISTTNPVATMQWGTLIPNCINMDSTDSGGNG

SEQ ID NO: 204653 - protein, 37 aa, Artificial Sequence
  Description of Artificial Sequence: Synthetic polypeptide
DEAEISTTNPCATEQYGCVCPWGEDDNQENFNSDTQA

SEQ ID NO: 204654 - protein, 38 aa, Artificial Sequence
  Description of Artificial Sequence: Synthetic polypeptide
DECSIRTTNPVAYEPYYQGVNINTRNDHLQPRSIEKHA

SEQ ID NO: 204655 - protein, 37 aa, Artificial Sequence
  Description of Artificial Sequence: Synthetic polypeptide
HEVVQCRTYMRNPAVATEVQYIPSVENTNFLTRDVTK

SEQ ID NO: 204656 - protein, 36 aa, Artificial Sequence
  Description of Artificial Sequence: Synthetic polypeptide
DEEVIACTNPVATEQWGANCAQNPPVNTAGNPEGTM

SEQ ID NO: 204657 - protein, 32 aa, Artificial Sequence
  Description of Artificial Sequence: Synthetic polypeptide
QEGEIACTNPCSYEQWGITCYCNDDQDQGDTK

SEQ ID NO: 204658 - protein, 36 aa, Artificial Sequence
  Description of Artificial Sequence: Synthetic polypeptide
AEAEIATTNPVATEGYGCVCSNWGEHNQEHFISEQA

SEQ ID NO: 204659 - protein, 38 aa, Artificial Sequence
  Description of Artificial Sequence: Synthetic polypeptide
DEAEISTTNPCATEQYGQCVCSNWEEHNAENFNSDNQA

SEQ ID NO: 204660 - protein, 35 aa, Artificial Sequence
  Description of Artificial Sequence: Synthetic polypeptide
SENEIATTNPVAYEGYGCVCSNWEHNAEHFISEQA

SEQ ID NO: 204661 - protein, 38 aa, Artificial Sequence
  Description of Artificial Sequence: Synthetic polypeptide
SEEEIATTNPVATEQYGQCSCPWGEDDNQEHFSSENQA

SEQ ID NO: 204662 - protein, 38 aa, Artificial Sequence
  Description of Artificial Sequence: Synthetic polypeptide
EEEEIATTNPVAYEQWGVVCYQVVTNEHNQVDDNDHGQ

SEQ ID NO: 204663 - protein, 35 aa, Artificial Sequence
  Description of Artificial Sequence: Synthetic polypeptide
DELEIRTTNPIATECWGATTWANAEDTAEPKGPYI

SEQ ID NO: 204664 - protein, 39 aa, Artificial Sequence
  Description of Artificial Sequence: Synthetic polypeptide
DDEEISTTNPVATEFYGCVTVNMTGLQIEDQDEGGETTT

SEQ ID NO: 204665 - protein, 37 aa, Artificial Sequence
  Description of Artificial Sequence: Synthetic polypeptide
CEEEIACTNPVATEQYGSACAANPAEGQAHQDDSSAK

SEQ ID NO: 204666 - protein, 36 aa, Artificial Sequence
  Description of Artificial Sequence: Synthetic polypeptide
EEEEIGCTNPTAYEQWGSTVYGELNDDHQGGDGKTH

SEQ ID NO: 204667 - protein, 39 aa, Artificial Sequence
  Description of Artificial Sequence: Synthetic polypeptide
DDECIRTTNPVATEQYGQCVCSNWGEDHNAENFNSDPQS

SEQ ID NO: 204668 - protein, 37 aa, Artificial Sequence
  Description of Artificial Sequence: Synthetic polypeptide
SEEEIATTNPVATEQYGCSCQNWMEDNIEHFISETQS

SEQ ID NO: 204669 - protein, 38 aa, Artificial Sequence
  Description of Artificial Sequence: Synthetic polypeptide
ADEEIRTTNPVGTEQWGQCVCSNWGEHNAENFGSDNQS

SEQ ID NO: 204670 - protein, 34 aa, Artificial Sequence
  Description of Artificial Sequence: Synthetic polypeptide
AEHEIASTNPVGYEAYGVVMAYSPGSHSQHVGDI

SEQ ID NO: 204671 - protein, 38 aa, Artificial Sequence
  Description of Artificial Sequence: Synthetic polypeptide
CEEEISTTNPVATEQYGQCVCSNWGEHNAENFISDTQA

SEQ ID NO: 204672 - protein, 36 aa, Artificial Sequence
  Description of Artificial Sequence: Synthetic polypeptide
SENEIATTNPVATEGYGQCVCSWEHNQEHFISETQA

SEQ ID NO: 204673 - protein, 38 aa, Artificial Sequence
  Description of Artificial Sequence: Synthetic polypeptide
DEAEISTTNPVATEEYGQCVCSNWGEHNAENFNSDNQS

SEQ ID NO: 204674 - protein, 39 aa, Artificial Sequence
  Description of Artificial Sequence: Synthetic polypeptide
DEECIRTTNPVATEQYSACVCSNWGEDHNAENFGSDTQA

SEQ ID NO: 204675 - protein, 39 aa, Artificial Sequence
  Description of Artificial Sequence: Synthetic polypeptide
CEEEISTTNPVATEQYGQCVCSNWGEGHNAENFISDTQS

SEQ ID NO: 204676 - protein, 37 aa, Artificial Sequence
  Description of Artificial Sequence: Synthetic polypeptide
SENEIATTNPVATEGYGCVCSNWGEGHNAEHFISEQA

SEQ ID NO: 204677 - protein, 35 aa, Artificial Sequence
  Description of Artificial Sequence: Synthetic polypeptide
AEGEIAPTNPCSYEQYGVTVSCLGMLSQGVGGTPP

SEQ ID NO: 204678 - protein, 37 aa, Artificial Sequence
  Description of Artificial Sequence: Synthetic polypeptide
SENEIATTNPVATEGYGCVCSNWEEHNQEHFISENQA

SEQ ID NO: 204679 - protein, 35 aa, Artificial Sequence
  Description of Artificial Sequence: Synthetic polypeptide
CESEIRTTNPVSTEPWGCIAPEDGGQQQQQRGTES

SEQ ID NO: 204680 - protein, 38 aa, Artificial Sequence
  Description of Artificial Sequence: Synthetic polypeptide
SEEEIATTNPVATEGYGQCVCSNWGEHNAEYFNSDTQS

SEQ ID NO: 204681 - protein, 36 aa, Artificial Sequence
  Description of Artificial Sequence: Synthetic polypeptide
SENEIATTNPVATEGYGCVCQWGEHNAEHFISENQA

SEQ ID NO: 204682 - protein, 38 aa, Artificial Sequence
  Description of Artificial Sequence: Synthetic polypeptide
DEECISTTNPVAYEQYGQCVCSNWEEHNAENFNSDTQA

SEQ ID NO: 204683 - protein, 40 aa, Artificial Sequence
  Description of Artificial Sequence: Synthetic polypeptide
DEEEIRTTNPVATLQYGTVAARLFELANIIEETSGAQNVE

SEQ ID NO: 204684 - protein, 36 aa, Artificial Sequence
  Description of Artificial Sequence: Synthetic polypeptide
SEAEIATTNPVATESWGAVFWNENDDHERQGMDQSQ

SEQ ID NO: 204685 - protein, 38 aa, Artificial Sequence
  Description of Artificial Sequence: Synthetic polypeptide
DEETAEIATTNPVAYERWGSAYITDNMNQGQDEHGDWQ

SEQ ID NO: 204686 - protein, 39 aa, Artificial Sequence
  Description of Artificial Sequence: Synthetic polypeptide
DEECIRTTNPVATEQYSAQCVCSWGEDHNQENFGSDTQA

SEQ ID NO: 204687 - protein, 37 aa, Artificial Sequence
  Description of Artificial Sequence: Synthetic polypeptide
DEDEIRTTNPVATEQWATCCAGAGAHPGDLHPDDSNG

SEQ ID NO: 204688 - protein, 37 aa, Artificial Sequence
  Description of Artificial Sequence: Synthetic polypeptide
DAAEIATTNPVATEQWGHCNVAATAGVLPAEAPMGMF

SEQ ID NO: 204689 - protein, 38 aa, Artificial Sequence
  Description of Artificial Sequence: Synthetic polypeptide
DDEEISTTNPVATCQYGQCVCSWGEDPNAENFGSQTQA

SEQ ID NO: 204690 - protein, 38 aa, Artificial Sequence
  Description of Artificial Sequence: Synthetic polypeptide
DEAEISTTNPVATEEYGQCVCSNWGEHNAENFNSDNQL

SEQ ID NO: 204691 - protein, 37 aa, Artificial Sequence
  Description of Artificial Sequence: Synthetic polypeptide
SEEEIATTNPVATAQWGHVVANANGDLPEANNHGTTQ

SEQ ID NO: 204692 - protein, 37 aa, Artificial Sequence
  Description of Artificial Sequence: Synthetic polypeptide
AEAEIATTNPVATCQYGCVCSWGADHNAENFGSDTQS

SEQ ID NO: 204693 - protein, 39 aa, Artificial Sequence
  Description of Artificial Sequence: Synthetic polypeptide
DEECIRTTNPVATEQYYAQCVCSNWGEHNQENFGSDTQA

SEQ ID NO: 204694 - protein, 36 aa, Artificial Sequence
  Description of Artificial Sequence: Synthetic polypeptide
DEMAIGTTNPVATEQYGCLCTATDGWPNEEFETDKQ

SEQ ID NO: 204695 - protein, 37 aa, Artificial Sequence
  Description of Artificial Sequence: Synthetic polypeptide
SEEEIATTNPVATAQWGANITTSAMNHLAGMPGGSHE

SEQ ID NO: 204696 - protein, 38 aa, Artificial Sequence
  Description of Artificial Sequence: Synthetic polypeptide
DEECIRTTNPVATEQYYAQCVCSWGEHNQENFISDTQA

SEQ ID NO: 204697 - protein, 38 aa, Artificial Sequence
  Description of Artificial Sequence: Synthetic polypeptide
ADEEIRTTNPVAYEQYGQCVCSNWGEHNQENFNSDNQM

SEQ ID NO: 204698 - protein, 39 aa, Artificial Sequence
  Description of Artificial Sequence: Synthetic polypeptide
DEEEISTTNPVATEQYGQCVCSMWGEDHNQENFISDTQA

SEQ ID NO: 204699 - protein, 39 aa, Artificial Sequence
  Description of Artificial Sequence: Synthetic polypeptide
CESTNAEIATTNPVATEGYGVVCQTLDNQDQDDQKGNTA

SEQ ID NO: 204700 - protein, 38 aa, Artificial Sequence
  Description of Artificial Sequence: Synthetic polypeptide
AENEISTTNPVATEQYGCVCSNWGEEHNQENFNSETQS

SEQ ID NO: 204701 - protein, 38 aa, Artificial Sequence
  Description of Artificial Sequence: Synthetic polypeptide
DDEEISTTNPVATEGYGCVCSNWGEDHNAENFNSETQS

SEQ ID NO: 204702 - protein, 38 aa, Artificial Sequence
  Description of Artificial Sequence: Synthetic polypeptide
DEAEIRTTNPIATEAWGCQTCGNSEEHNAEYSGSDNQS

SEQ ID NO: 204703 - protein, 38 aa, Artificial Sequence
  Description of Artificial Sequence: Synthetic polypeptide
SEEEIATTNPVATEQWGHVVANAGPAQGTEHQDDNLAK

SEQ ID NO: 204704 - protein, 37 aa, Artificial Sequence
  Description of Artificial Sequence: Synthetic polypeptide
DEAEISTTNPVATCHYGCVCSNWGEHNQEYFTSDNQS

SEQ ID NO: 204705 - protein, 35 aa, Artificial Sequence
  Description of Artificial Sequence: Synthetic polypeptide
SEAEIATTNPVAYEAWGVVWPGPNNENDTGQNGSE

SEQ ID NO: 204706 - protein, 37 aa, Artificial Sequence
  Description of Artificial Sequence: Synthetic polypeptide
DEAEISTTNPVATCHYGQCVCSWGEHNAEYFTSDNQA

SEQ ID NO: 204707 - protein, 38 aa, Artificial Sequence
  Description of Artificial Sequence: Synthetic polypeptide
DEAEIRTTNPVATEGWGCVCSNWGEDENAEYFNSDTQA

SEQ ID NO: 204708 - protein, 37 aa, Artificial Sequence
  Description of Artificial Sequence: Synthetic polypeptide
AEAEIATTNPVATEQYGQCSCPNWEDNAEHFISENQA

SEQ ID NO: 204709 - protein, 36 aa, Artificial Sequence
  Description of Artificial Sequence: Synthetic polypeptide
CETEIACTNPVATEQWGCVAGTEGLEAGPSGEEDAW

SEQ ID NO: 204710 - protein, 36 aa, Artificial Sequence
  Description of Artificial Sequence: Synthetic polypeptide
SENEIATTNPVATEGYGCVCSWEEHNAENFISETQA

SEQ ID NO: 204711 - protein, 36 aa, Artificial Sequence
  Description of Artificial Sequence: Synthetic polypeptide
SENEIATTNPVATEGYGCVCSWEEDHNQEHFISEQA

SEQ ID NO: 204712 - protein, 38 aa, Artificial Sequence
  Description of Artificial Sequence: Synthetic polypeptide
DDEEISTTNPVATEGYGCVCSNWEEDHNQEHFNSETQA

SEQ ID NO: 204713 - protein, 38 aa, Artificial Sequence
  Description of Artificial Sequence: Synthetic polypeptide
DDECIRTTNPVAYEGYGCVTSTWGADHNAENFGSDPQA

SEQ ID NO: 204714 - protein, 37 aa, Artificial Sequence
  Description of Artificial Sequence: Synthetic polypeptide
AENEISTTNPVATEGYGCVCSNWGEDNQEHFISENQA

SEQ ID NO: 204715 - protein, 37 aa, Artificial Sequence
  Description of Artificial Sequence: Synthetic polypeptide
IEEEIDTTNVVCSTECQYGVDVVLAVTLELSQTQEQD

SEQ ID NO: 204716 - protein, 35 aa, Artificial Sequence
  Description of Artificial Sequence: Synthetic polypeptide
DELEIRTTNPIATECWGATTWANANDWAEPKGPYI

SEQ ID NO: 204717 - protein, 38 aa, Artificial Sequence
  Description of Artificial Sequence: Synthetic polypeptide
CESEISTTNPVAYEQWGSVYHGENQDLQEGTQGQQHQG

SEQ ID NO: 204718 - protein, 37 aa, Artificial Sequence
  Description of Artificial Sequence: Synthetic polypeptide
SENEIATTNPVATEGYGCVCSTWGEDDNAEHFISEQA

SEQ ID NO: 204719 - protein, 36 aa, Artificial Sequence
  Description of Artificial Sequence: Synthetic polypeptide
SEAEIRCTNPCATEQYGCVCSNWGEDNAENFISDQS

SEQ ID NO: 204720 - protein, 35 aa, Artificial Sequence
  Description of Artificial Sequence: Synthetic polypeptide
DELEIRTTNPIATECWGATTWHNAEDWAEPKGPYI

SEQ ID NO: 204721 - protein, 40 aa, Artificial Sequence
  Description of Artificial Sequence: Synthetic polypeptide
DEEEIRTTNPVATLQYGTVAARSFELANIIEETSFAQNYE

SEQ ID NO: 204722 - protein, 38 aa, Artificial Sequence
  Description of Artificial Sequence: Synthetic polypeptide
DEAEISCTNPVATEQYGCVCSNWGEDDNDEYFNSDTQS

SEQ ID NO: 204723 - protein, 38 aa, Artificial Sequence
  Description of Artificial Sequence: Synthetic polypeptide
DDEEISTTNPVATEGYGCVCSNWGEDHNAENFNSDTQA

SEQ ID NO: 204724 - protein, 38 aa, Artificial Sequence
  Description of Artificial Sequence: Synthetic polypeptide
DDEEISTTNPVATEGYGCVCSNWGEDHNAENFNSDTQP

SEQ ID NO: 204725 - protein, 38 aa, Artificial Sequence
  Description of Artificial Sequence: Synthetic polypeptide
DEECISTTNPVAYEQYGQCVCSNSGEHNQENFNSDTQA

SEQ ID NO: 204726 - protein, 37 aa, Artificial Sequence
  Description of Artificial Sequence: Synthetic polypeptide
SEAEIRCTNPCATEQYGCVCSNWMEDNAENFNSDTQS

SEQ ID NO: 204727 - protein, 37 aa, Artificial Sequence
  Description of Artificial Sequence: Synthetic polypeptide
DEGEIATTNPVATAQWGHVVANTGPGEYGAEGDGNTL

SEQ ID NO: 204728 - protein, 39 aa, Artificial Sequence
  Description of Artificial Sequence: Synthetic polypeptide
DAAEIATTNPVATEQYGSTACAPVNPAEGQNHQDGMQMG

SEQ ID NO: 204729 - protein, 38 aa, Artificial Sequence
  Description of Artificial Sequence: Synthetic polypeptide
DEEEIRTTNPVATEGYGCFCSNWGEDHNAENFDSDTQS

SEQ ID NO: 204730 - protein, 39 aa, Artificial Sequence
  Description of Artificial Sequence: Synthetic polypeptide
DEEEISTTNPVATEQYGQCVCGNWGEDHNAENFGSDTQA

SEQ ID NO: 204731 - protein, 39 aa, Artificial Sequence
  Description of Artificial Sequence: Synthetic polypeptide
DEEEISTTNPVATEQYGQCVCGNWGEDHNTENSNSQTQS

SEQ ID NO: 204732 - protein, 39 aa, Artificial Sequence
  Description of Artificial Sequence: Synthetic polypeptide
DEEEISTTNPVATEQYGQCVCGNWGEDHNAENFISETQS

SEQ ID NO: 204733 - protein, 36 aa, Artificial Sequence
  Description of Artificial Sequence: Synthetic polypeptide
SESEIACTNPVGTEGYGQCSCGSGEHNQHFGSDNQS

SEQ ID NO: 204734 - protein, 35 aa, Artificial Sequence
  Description of Artificial Sequence: Synthetic polypeptide
DETEIRTTNPVATECWGATTWANAEDWAEPKEPYA

SEQ ID NO: 204735 - protein, 38 aa, Artificial Sequence
  Description of Artificial Sequence: Synthetic polypeptide
DEECISTTNPVAYEQYGQCVCSNWGEHNAENFNSDTQS

SEQ ID NO: 204736 - protein, 34 aa, Artificial Sequence
  Description of Artificial Sequence: Synthetic polypeptide
SESEIASTNPVGYEAYGQVVMAYSPGLSLHVGDI

SEQ ID NO: 204737 - protein, 39 aa, Artificial Sequence
  Description of Artificial Sequence: Synthetic polypeptide
SEMEIRTTNPVATEQYGQCVCSNWGEDHNAENFNSDFQA

SEQ ID NO: 204738 - protein, 37 aa, Artificial Sequence
  Description of Artificial Sequence: Synthetic polypeptide
SEMEIRCTNPVATEQYGQCVCEWGEHNQEHFGSDTQA

SEQ ID NO: 204739 - protein, 39 aa, Artificial Sequence
  Description of Artificial Sequence: Synthetic polypeptide
DEAEISTTNPVATEGYGQCVCSMWGEDTNAENFNSENQA

SEQ ID NO: 204740 - protein, 38 aa, Artificial Sequence
  Description of Artificial Sequence: Synthetic polypeptide
DEECISTTNPVAYEQYGCVCSNWGEDHNAENFNSDTQA

SEQ ID NO: 204741 - protein, 37 aa, Artificial Sequence
  Description of Artificial Sequence: Synthetic polypeptide
DEAEIRTTNPVATEQWGAYWCFWTESVDEEHEANMME

SEQ ID NO: 204742 - protein, 39 aa, Artificial Sequence
  Description of Artificial Sequence: Synthetic polypeptide
DEEEIRGTNPVATEQWGHVNVDDNMNFFQHEGEGQGETN

SEQ ID NO: 204743 - protein, 39 aa, Artificial Sequence
  Description of Artificial Sequence: Synthetic polypeptide
DEEEISTTNPVATEQYGQCVCGNWEEDHNAEGFISDTQS

SEQ ID NO: 204744 - protein, 38 aa, Artificial Sequence
  Description of Artificial Sequence: Synthetic polypeptide
DEECISTTNPVAYEQYGQCVCSNWGEHNDENFNSDTQA

SEQ ID NO: 204745 - protein, 36 aa, Artificial Sequence
  Description of Artificial Sequence: Synthetic polypeptide
DETEIRTTNPVATECWGATTWANAEDWVAEPKGPYD

SEQ ID NO: 204746 - protein, 34 aa, Artificial Sequence
  Description of Artificial Sequence: Synthetic polypeptide
SESEIASTNPVGTEGYGVICGSELNQHFGSDTQS

SEQ ID NO: 204747 - protein, 38 aa, Artificial Sequence
  Description of Artificial Sequence: Synthetic polypeptide
QAGEICTTNPVATEQYGNISFSAPPDTLREPHEGEDTR

SEQ ID NO: 204748 - protein, 38 aa, Artificial Sequence
  Description of Artificial Sequence: Synthetic polypeptide
DEECISTTNPVAYEQYGCVCSNWGEDHNQENFNSDTQS

SEQ ID NO: 204749 - protein, 39 aa, Artificial Sequence
  Description of Artificial Sequence: Synthetic polypeptide
DEEEISTTNPVATEQYGQCVCSNWGEDHNAENFSSETQA

SEQ ID NO: 204750 - protein, 39 aa, Artificial Sequence
  Description of Artificial Sequence: Synthetic polypeptide
DEEEISTTNPVATEQYGQCVCGNWGEDHNAENFISDTQS

SEQ ID NO: 204751 - protein, 39 aa, Artificial Sequence
  Description of Artificial Sequence: Synthetic polypeptide
DEEEISTTNPVATEQYGQCVCGNWGEDHNAENFISDTQA

SEQ ID NO: 204752 - protein, 39 aa, Artificial Sequence
  Description of Artificial Sequence: Synthetic polypeptide
DEEEISTTNPVATEQYGQCVCSNWGEDHNAENFISDTQA

SEQ ID NO: 204753 - protein, 38 aa, Artificial Sequence
  Description of Artificial Sequence: Synthetic polypeptide
DEAEISTTNPVATEGYGQCVCSNWEEHNTESFNSDTQS

SEQ ID NO: 204754 - protein, 38 aa, Artificial Sequence
  Description of Artificial Sequence: Synthetic polypeptide
DEECISTTNPVAYEQYGCVCSNSGEDHNAEFFNSDTQS

SEQ ID NO: 204755 - protein, 38 aa, Artificial Sequence
  Description of Artificial Sequence: Synthetic polypeptide
DEECISTTNPVAYEQYGCVCSNWGEDHNQENFNSDTQA

SEQ ID NO: 204756 - protein, 39 aa, Artificial Sequence
  Description of Artificial Sequence: Synthetic polypeptide
DEEEISTTNPVATEQYGQCVCGNWGEDPNAENFNSDTQS

SEQ ID NO: 204757 - protein, 38 aa, Artificial Sequence
  Description of Artificial Sequence: Synthetic polypeptide
SEMEIRTTNPVATEGYGQCVCFNWGEHNTENFNSDNQS

SEQ ID NO: 204758 - protein, 40 aa, Artificial Sequence
  Description of Artificial Sequence: Synthetic polypeptide
DEETIRTTNPVATEQYGVVVVVVVVVTQGNNQQNTTTDEL

SEQ ID NO: 204759 - protein, 38 aa, Artificial Sequence
  Description of Artificial Sequence: Synthetic polypeptide
DEECISTTNPVAYEQYGCVCSNWGEDHNAENFNSETQS

SEQ ID NO: 204760 - protein, 38 aa, Artificial Sequence
  Description of Artificial Sequence: Synthetic polypeptide
DDEEISCTNPVATEQYGQCVCSWGEDHNAENFNSDTQA

SEQ ID NO: 204761 - protein, 39 aa, Artificial Sequence
  Description of Artificial Sequence: Synthetic polypeptide
DDECIRTTNPVATEQYGQCVCSNWGEDHNAEFFNSDTQS

SEQ ID NO: 204762 - protein, 35 aa, Artificial Sequence
  Description of Artificial Sequence: Synthetic polypeptide
DEGEIATTNPVATAQWGTNCAATDGHPMEFEINDN

SEQ ID NO: 204763 - protein, 35 aa, Artificial Sequence
  Description of Artificial Sequence: Synthetic polypeptide
DETEIRTTNPVATECWGATTWAAIDWPAEPEGPYI

SEQ ID NO: 204764 - protein, 39 aa, Artificial Sequence
  Description of Artificial Sequence: Synthetic polypeptide
DEAEISTTNPVATEGYGQCVCSNWEEPHNTENFNSDNQS

SEQ ID NO: 204765 - protein, 34 aa, Artificial Sequence
  Description of Artificial Sequence: Synthetic polypeptide
DEGEIATTNPVATAQWGTNCAAIDGHPMETEIND

SEQ ID NO: 204766 - protein, 37 aa, Artificial Sequence
  Description of Artificial Sequence: Synthetic polypeptide
DDEEISTTNPQATEHYGCVCSWGEADNAENFNSDTQA

SEQ ID NO: 204767 - protein, 36 aa, Artificial Sequence
  Description of Artificial Sequence: Synthetic polypeptide
EEAEEATTNPVAYEPWGVVVHTDQGLQDDRHGGTEH

SEQ ID NO: 204768 - protein, 39 aa, Artificial Sequence
  Description of Artificial Sequence: Synthetic polypeptide
DEAEISTTNPVATEGYGQCVCSNSGEDHNAENFGSDNQS

SEQ ID NO: 204769 - protein, 39 aa, Artificial Sequence
  Description of Artificial Sequence: Synthetic polypeptide
DEEEISTTNPVATEQYGQCVCSNWGEDHNAENFPSETQM

SEQ ID NO: 204770 - protein, 38 aa, Artificial Sequence
  Description of Artificial Sequence: Synthetic polypeptide
DEECISTTNPVAYEQYGCVCSNSGEDHNAENFNSDTQA

SEQ ID NO: 204771 - protein, 38 aa, Artificial Sequence
  Description of Artificial Sequence: Synthetic polypeptide
DEECISTTNPVAYEQYGCVCSNWGEDHNAEFFNSDNQA

SEQ ID NO: 204772 - protein, 38 aa, Artificial Sequence
  Description of Artificial Sequence: Synthetic polypeptide
DEECISTTNPVAYEQYGQCVCSNWGEHNAENFNSDTQA

SEQ ID NO: 204773 - protein, 37 aa, Artificial Sequence
  Description of Artificial Sequence: Synthetic polypeptide
DDEEISTTNPCATEHYGCVCSNWGEPNQEYFNSDTQS

SEQ ID NO: 204774 - protein, 39 aa, Artificial Sequence
  Description of Artificial Sequence: Synthetic polypeptide
DEECISTTNPVAYEQYGQCVCSNWGEDTNAENFNSDTQA

SEQ ID NO: 204775 - protein, 39 aa, Artificial Sequence
  Description of Artificial Sequence: Synthetic polypeptide
DEECISTTNPVAYEQYGQCVCSNWGEDHNTENFISDNQG

SEQ ID NO: 204776 - protein, 38 aa, Artificial Sequence
  Description of Artificial Sequence: Synthetic polypeptide
DEECISTTNPVATEEYGCVCSNWGEDHNQENFNSDTQS

SEQ ID NO: 204777 - protein, 39 aa, Artificial Sequence
  Description of Artificial Sequence: Synthetic polypeptide
DEEEISTTNPVATEQYGQCVCSNWGEDHNIENFISDTQA

SEQ ID NO: 204778 - protein, 40 aa, Artificial Sequence
  Description of Artificial Sequence: Synthetic polypeptide
DEEEIRGTNPVATEQWGEVNVDDNEQNFLQHEGPGQGETP

SEQ ID NO: 204779 - protein, 37 aa, Artificial Sequence
  Description of Artificial Sequence: Synthetic polypeptide
DEECISTTNPVAYEQYGCVCSNWGEDNAENFISDTQA

SEQ ID NO: 204780 - protein, 35 aa, Artificial Sequence
  Description of Artificial Sequence: Synthetic polypeptide
SESEIACTNPVAYEGYGEACSCENGSQAQVGGDTE

SEQ ID NO: 204781 - protein, 39 aa, Artificial Sequence
  Description of Artificial Sequence: Synthetic polypeptide
DEEEISTTNPVATEQYGQCVCSNWGEDHNAENFISDTQS

SEQ ID NO: 204782 - protein, 39 aa, Artificial Sequence
  Description of Artificial Sequence: Synthetic polypeptide
DEEEISTTNPVATEQYGQCVCGNWGEDHNAENFNSDTQS

SEQ ID NO: 204783 - protein, 39 aa, Artificial Sequence
  Description of Artificial Sequence: Synthetic polypeptide
DEEEISTTNPVATEQYGQCVCGNWGEDHNQEHFMSDTQS

SEQ ID NO: 204784 - protein, 35 aa, Artificial Sequence
  Description of Artificial Sequence: Synthetic polypeptide
SESEIACTNPVAYEGYGEACSCENGSQEAVGGDTV

SEQ ID NO: 204785 - protein, 37 aa, Artificial Sequence
  Description of Artificial Sequence: Synthetic polypeptide
CEEEIACTNPVATEQYGCACGSGGGHQPDAGIDIEDD

SEQ ID NO: 204786 - protein, 36 aa, Artificial Sequence
  Description of Artificial Sequence: Synthetic polypeptide
DEECISTTNPVAYEQYGCVCQWGEHNQENFDSDTQA

SEQ ID NO: 204787 - protein, 39 aa, Artificial Sequence
  Description of Artificial Sequence: Synthetic polypeptide
DEEEISTTNPVATEQYGQCVCSNWGEDHNAENFISETQA

SEQ ID NO: 204788 - protein, 38 aa, Artificial Sequence
  Description of Artificial Sequence: Synthetic polypeptide
DEECISTTNPVAYEQYGQCVCSNWGEHNTENFISDTQP

SEQ ID NO: 204789 - protein, 35 aa, Artificial Sequence
  Description of Artificial Sequence: Synthetic polypeptide
SESEIACTNPVAYEGYGEACSCENGSQNAYVGGDT

SEQ ID NO: 204790 - protein, 37 aa, Artificial Sequence
  Description of Artificial Sequence: Synthetic polypeptide
AEEEVSTTNPVAYEQYGCVCSNWGEHNAEYINSDTQS

SEQ ID NO: 204791 - protein, 39 aa, Artificial Sequence
  Description of Artificial Sequence: Synthetic polypeptide
DEEEISTTNPVATEQYGQCVCGNWGEDHNAEYFNSETQA

SEQ ID NO: 204792 - protein, 38 aa, Artificial Sequence
  Description of Artificial Sequence: Synthetic polypeptide
QEHEIRTTNPVTTEHWGSVYCWIPNDQDDQRQGGDGSI

SEQ ID NO: 204793 - protein, 38 aa, Artificial Sequence
  Description of Artificial Sequence: Synthetic polypeptide
DEAEIRTTNPVATEQWGAYWCFMTERVTEENYEAGGME

SEQ ID NO: 204794 - protein, 38 aa, Artificial Sequence
  Description of Artificial Sequence: Synthetic polypeptide
DEECISTTNPVAYEQYGCVCSNWGEDHNQENFNSEFQG

SEQ ID NO: 204795 - protein, 39 aa, Artificial Sequence
  Description of Artificial Sequence: Synthetic polypeptide
DEEEISTTNPVATEQYGQCVCGNWGEDHNAENFNSDTQQ

SEQ ID NO: 204796 - protein, 37 aa, Artificial Sequence
  Description of Artificial Sequence: Synthetic polypeptide
SEEEIACTNPVAYEQWGSVPAITNHADEATGELGEQM

SEQ ID NO: 204797 - protein, 39 aa, Artificial Sequence
  Description of Artificial Sequence: Synthetic polypeptide
DEEEISTTNPVATEQYGQCVCSNWGEDHNIENFISETQS

SEQ ID NO: 204798 - protein, 32 aa, Artificial Sequence
  Description of Artificial Sequence: Synthetic polypeptide
EGANEIATTNPVAYEQWGCCHQWEDQGHKSGD

SEQ ID NO: 204799 - protein, 36 aa, Artificial Sequence
  Description of Artificial Sequence: Synthetic polypeptide
DETEIRTTNPVATECWGATTWANAEDWAEPKGEPYI

SEQ ID NO: 204800 - protein, 39 aa, Artificial Sequence
  Description of Artificial Sequence: Synthetic polypeptide
DEEEISTTNPVATEQYGQCVCGNWGEDHNAENFNSDTQA

SEQ ID NO: 204801 - protein, 35 aa, Artificial Sequence
  Description of Artificial Sequence: Synthetic polypeptide
DEDAIGTTNPVATEQYGCLITATDGWPVEFETDKQ

SEQ ID NO: 204802 - protein, 39 aa, Artificial Sequence
  Description of Artificial Sequence: Synthetic polypeptide
DEEEISTTNPVATEQYGQCVCSNWGEDHNAENFISETQS

SEQ ID NO: 204803 - protein, 39 aa, Artificial Sequence
  Description of Artificial Sequence: Synthetic polypeptide
DEEEISTTNPVATEQYGQCVCSNWGEDHNAENFMSDTQA

SEQ ID NO: 204804 - protein, 40 aa, Artificial Sequence
  Description of Artificial Sequence: Synthetic polypeptide
DEEEIRGTNPVATEQWGEVNVDDNEVNFLQHEGEGQGETM

SEQ ID NO: 204805 - protein, 37 aa, Artificial Sequence
  Description of Artificial Sequence: Synthetic polypeptide
DCGEIRTTNPVAYEQYGGHTVFIASPDESHFMQDDIQ

SEQ ID NO: 204806 - protein, 39 aa, Artificial Sequence
  Description of Artificial Sequence: Synthetic polypeptide
DEEEISTTNPVATEQYGQCVCSNWGEDHNAENFISDTQP

SEQ ID NO: 204807 - protein, 38 aa, Artificial Sequence
  Description of Artificial Sequence: Synthetic polypeptide
DCGEIRTTNPVAYEQYGGHTVFPASPDESHFSLQDDIQ

SEQ ID NO: 204808 - protein, 39 aa, Artificial Sequence
  Description of Artificial Sequence: Synthetic polypeptide
DDEEISTTNPVAYEQYGQCVCSNWGEDHNAENFGSDTQA

SEQ ID NO: 204809 - protein, 38 aa, Artificial Sequence
  Description of Artificial Sequence: Synthetic polypeptide
DEMEIRTTNPCATEGWGCQSCFNWEEDNAEHSGSDNQS

SEQ ID NO: 204810 - protein, 39 aa, Artificial Sequence
  Description of Artificial Sequence: Synthetic polypeptide
DDEEISTTNPVAYEQYGQCVCSNWGEDHNAEHFNSDTQL

SEQ ID NO: 204811 - protein, 38 aa, Artificial Sequence
  Description of Artificial Sequence: Synthetic polypeptide
CEEEIACTNPVATEQWGNTTAKTGNILTAPDDLMDNGM

SEQ ID NO: 204812 - protein, 38 aa, Artificial Sequence
  Description of Artificial Sequence: Synthetic polypeptide
CDEEISTTNPVAYEQYGCVCSNWGEDHNAENFNSDTQA

SEQ ID NO: 204813 - protein, 37 aa, Artificial Sequence
  Description of Artificial Sequence: Synthetic polypeptide
QESEIAPTNPCSYEQYGVTVSCCWNMHSQNSNGGTDR

SEQ ID NO: 204814 - protein, 38 aa, Artificial Sequence
  Description of Artificial Sequence: Synthetic polypeptide
CDEEISTTNPVAYEQYGCVCSNWGEDHNAENFGSDTQA

SEQ ID NO: 204815 - protein, 39 aa, Artificial Sequence
  Description of Artificial Sequence: Synthetic polypeptide
DDEEISTTNPVAYEQYGQCVCSNWGEDHNAENFNSDNQA

SEQ ID NO: 204816 - protein, 39 aa, Artificial Sequence
  Description of Artificial Sequence: Synthetic polypeptide
DDEEISTTNPVAYEQYGQCVCSNWGEDHNQEYFNSDNQG

SEQ ID NO: 204817 - protein, 35 aa, Artificial Sequence
  Description of Artificial Sequence: Synthetic polypeptide
TNGTEIATTNPVAYEQWGCVMGDQDEKGGRGGTTK

SEQ ID NO: 204818 - protein, 36 aa, Artificial Sequence
  Description of Artificial Sequence: Synthetic polypeptide
NEMAIGTTNPVATEQYGCLCTAPDGSPVEFETNDKQ

SEQ ID NO: 204819 - protein, 39 aa, Artificial Sequence
  Description of Artificial Sequence: Synthetic polypeptide
DDEEISTTNPVAYEQYGQCVCSNWGEDHNAEHFNSDNQS

SEQ ID NO: 204820 - protein, 36 aa, Artificial Sequence
  Description of Artificial Sequence: Synthetic polypeptide
SEAEIATTNPVAYEQWGHACAYTGMPEIDDQRTEAA

SEQ ID NO: 204821 - protein, 37 aa, Artificial Sequence
  Description of Artificial Sequence: Synthetic polypeptide
QESEIAPTNPCSYEQYGVTVSCCGHMLSQHSNGGTDR

SEQ ID NO: 204822 - protein, 38 aa, Artificial Sequence
  Description of Artificial Sequence: Synthetic polypeptide
DEAEISTTNPVAYEGYGCVCSNWGEDHNTENFNSDPQS

SEQ ID NO: 204823 - protein, 39 aa, Artificial Sequence
  Description of Artificial Sequence: Synthetic polypeptide
DDEEISTTNPVAYEQYGQCVCSNWGEDHNAENFNSETQM

SEQ ID NO: 204824 - protein, 38 aa, Artificial Sequence
  Description of Artificial Sequence: Synthetic polypeptide
CDECISTTNPVATEQYGCVCSNWGEDDNQENFNSDTQA

SEQ ID NO: 204825 - protein, 39 aa, Artificial Sequence
  Description of Artificial Sequence: Synthetic polypeptide
DDEEISTTNPVAYEQYGQCVCSNWGEDHNAEHFNSDTQA

SEQ ID NO: 204826 - protein, 39 aa, Artificial Sequence
  Description of Artificial Sequence: Synthetic polypeptide
DDEEISTTNPVAYEQYGQCVCSNWGEDHNQENFNSDTQS

SEQ ID NO: 204827 - protein, 39 aa, Artificial Sequence
  Description of Artificial Sequence: Synthetic polypeptide
DDEEISTTNPVAYEQYGQCVCSNWGEDHNAEYFNSDTQQ

SEQ ID NO: 204828 - protein, 38 aa, Artificial Sequence
  Description of Artificial Sequence: Synthetic polypeptide
CDECISTTNPVATEQYGCQVCSNWGEHNAENFNSDFQS

SEQ ID NO: 204829 - protein, 39 aa, Artificial Sequence
  Description of Artificial Sequence: Synthetic polypeptide
DEESIATTNPVAYEPQWGHSACAAANGQDAMQAGNDVHM

SEQ ID NO: 204830 - protein, 37 aa, Artificial Sequence
  Description of Artificial Sequence: Synthetic polypeptide
VEDEIACTNPVAYEQYGSVANANAFIGAPDDSMEKAN

SEQ ID NO: 204831 - protein, 39 aa, Artificial Sequence
  Description of Artificial Sequence: Synthetic polypeptide
DDEEISTTNPVAYEQYGQCVCSNWGEDHNAEYFNSDTQG

SEQ ID NO: 204832 - protein, 33 aa, Artificial Sequence
  Description of Artificial Sequence: Synthetic polypeptide
QEGEIASTNPCSYEAWGITCYCNDQQDHGDTRG

SEQ ID NO: 204833 - protein, 38 aa, Artificial Sequence
  Description of Artificial Sequence: Synthetic polypeptide
DEAEISTTNPVAYEGYGCVTSTWGADHNAENFISDPQA

SEQ ID NO: 204834 - protein, 34 aa, Artificial Sequence
  Description of Artificial Sequence: Synthetic polypeptide
DDSEVATTNPIATEGWGNTTWANNETWASPVGPR

SEQ ID NO: 204835 - protein, 38 aa, Artificial Sequence
  Description of Artificial Sequence: Synthetic polypeptide
DDEEISTTNPVATEGYGCVCGNWGEDHNAENFNSDTQS

SEQ ID NO: 204836 - protein, 39 aa, Artificial Sequence
  Description of Artificial Sequence: Synthetic polypeptide
DTNEIRTTNPVATEQYGTQVWTCDYSEPVTTEVHEDHEG

SEQ ID NO: 204837 - protein, 39 aa, Artificial Sequence
  Description of Artificial Sequence: Synthetic polypeptide
DEECISTTNPVATEGYGQCVCSNWEEDHNAENFNSDTQL

SEQ ID NO: 204838 - protein, 38 aa, Artificial Sequence
  Description of Artificial Sequence: Synthetic polypeptide
DEECISCTNPVATEGYGCVCSNWGEDDNQENFNSDTQS

SEQ ID NO: 204839 - protein, 36 aa, Artificial Sequence
  Description of Artificial Sequence: Synthetic polypeptide
DEDEIATTNPVAYEPWGRPPPAGQGPALNHQDGTAV

SEQ ID NO: 204840 - protein, 37 aa, Artificial Sequence
  Description of Artificial Sequence: Synthetic polypeptide
YGNEIRKTNNPVAFEGGSEVSCTNNRVYEPRGSGDGT

SEQ ID NO: 204841 - protein, 39 aa, Artificial Sequence
  Description of Artificial Sequence: Synthetic polypeptide
DDEEISTTNPVAYEQYGQCVCSNWVEDHNAENFNSDTQS

SEQ ID NO: 204842 - protein, 40 aa, Artificial Sequence
  Description of Artificial Sequence: Synthetic polypeptide
DENEIRTTNPVATEQYGAASCMCEAGVDLLQESVVQEDDN

SEQ ID NO: 204843 - protein, 36 aa, Artificial Sequence
  Description of Artificial Sequence: Synthetic polypeptide
DEMEIRTTNPIATECWGATTWANTEGWVEEFKGPYI

SEQ ID NO: 204844 - protein, 37 aa, Artificial Sequence
  Description of Artificial Sequence: Synthetic polypeptide
DDEEISTTNPVGTEGWGCVCSNWGEDNAENFNSVNQS

SEQ ID NO: 204845 - protein, 35 aa, Artificial Sequence
  Description of Artificial Sequence: Synthetic polypeptide
DESETRTTNPIATECWGATTWANAEDWAEPKGPYI

SEQ ID NO: 204846 - protein, 39 aa, Artificial Sequence
  Description of Artificial Sequence: Synthetic polypeptide
DEAEIRTTNPVATEWYGQAWYTYMTDPYVQDLEINDYQE

SEQ ID NO: 204847 - protein, 39 aa, Artificial Sequence
  Description of Artificial Sequence: Synthetic polypeptide
CEEEIGTTNPVATEGYGQCVCSNWGEDHNQENFNSDFQA

SEQ ID NO: 204848 - protein, 39 aa, Artificial Sequence
  Description of Artificial Sequence: Synthetic polypeptide
CEEEISTTNPVATEQYGQCVCSNWGEDHNIEYFISETQA

SEQ ID NO: 204849 - protein, 39 aa, Artificial Sequence
  Description of Artificial Sequence: Synthetic polypeptide
DESEIRCTNPAATEQYGVVVMDEMQDNNLGVNEFGQTFQ

SEQ ID NO: 204850 - protein, 39 aa, Artificial Sequence
  Description of Artificial Sequence: Synthetic polypeptide
DESEIRCTNCVATEQYGDYAVNMDTGIPGEIGDQEGEQY

SEQ ID NO: 204851 - protein, 39 aa, Artificial Sequence
  Description of Artificial Sequence: Synthetic polypeptide
DESEIRCTNCVATEQYGDYATNMDTGISGEFGDQEGDQE

SEQ ID NO: 204852 - protein, 36 aa, Artificial Sequence
  Description of Artificial Sequence: Synthetic polypeptide
DESEIRATNPVSTEPWGCIAPEDGQQQQQQRHGTES

SEQ ID NO: 204853 - protein, 39 aa, Artificial Sequence
  Description of Artificial Sequence: Synthetic polypeptide
DDEEISTTNPVATEGYGQCVCSNWGEDHNAENFNSDTQG

SEQ ID NO: 204854 - protein, 38 aa, Artificial Sequence
  Description of Artificial Sequence: Synthetic polypeptide
DEAEISTTNPVAYEGYGICVCSTWVEDNAENFISDTQA

SEQ ID NO: 204855 - protein, 38 aa, Artificial Sequence
  Description of Artificial Sequence: Synthetic polypeptide
DEMAIATTNPVATEQYGQCVCSNWMEHNAEHFISETQA

SEQ ID NO: 204856 - protein, 39 aa, Artificial Sequence
  Description of Artificial Sequence: Synthetic polypeptide
DEECISCTNPVATEGYGQCQVCSNWEEHNTENFNSDNQA

SEQ ID NO: 204857 - protein, 38 aa, Artificial Sequence
  Description of Artificial Sequence: Synthetic polypeptide
CDEEISTTNPVATEQYGQCVCPNWGEHNAEHFNSDTQA

SEQ ID NO: 204858 - protein, 36 aa, Artificial Sequence
  Description of Artificial Sequence: Synthetic polypeptide
DEDEIATTNPVAYEPWGRPPAGQGPALQHQDGMQAQ

SEQ ID NO: 204859 - protein, 39 aa, Artificial Sequence
  Description of Artificial Sequence: Synthetic polypeptide
DEDEIATTNPVAYEQWGSIICPAVADAGQNDHQGDNAEN

SEQ ID NO: 204860 - protein, 38 aa, Artificial Sequence
  Description of Artificial Sequence: Synthetic polypeptide
DEDEIATTNPVAYEQWGSIICPAVADAGQDHQIDNMAM

SEQ ID NO: 204861 - protein, 35 aa, Artificial Sequence
  Description of Artificial Sequence: Synthetic polypeptide
DDSEVASTNPVSTEGYGCVCQNSEINAEHFGSQQS

SEQ ID NO: 204862 - protein, 35 aa, Artificial Sequence
  Description of Artificial Sequence: Synthetic polypeptide
DDSEVASTNPVSTEGYGCVCQNSEDQEYFGSQTQS

SEQ ID NO: 204863 - protein, 36 aa, Artificial Sequence
  Description of Artificial Sequence: Synthetic polypeptide
VEDEIATTNPVAYEPYGSFTPAANNGETGTGGSMEK

SEQ ID NO: 204864 - protein, 38 aa, Artificial Sequence
  Description of Artificial Sequence: Synthetic polypeptide
DENCISTTNPVATEGYGQCVCSNWGEHNAENFNSDTQA

SEQ ID NO: 204865 - protein, 36 aa, Artificial Sequence
  Description of Artificial Sequence: Synthetic polypeptide
DDSEVASTNPVSTEGYGCVCGTWELHNQEYFGSQQA

SEQ ID NO: 204866 - protein, 37 aa, Artificial Sequence
  Description of Artificial Sequence: Synthetic polypeptide
QESEIAPTNPCSYEQYGVTVSCIQHMLSQNSNGGTDR

SEQ ID NO: 204867 - protein, 39 aa, Artificial Sequence
  Description of Artificial Sequence: Synthetic polypeptide
CEEEISTTNPVATEQYGQCVCSNWEEDPNTEHFISDTQS

SEQ ID NO: 204868 - protein, 38 aa, Artificial Sequence
  Description of Artificial Sequence: Synthetic polypeptide
DEEEIATTNPVAWYDQYGCTIPNPNVDPQEASINEQTS

SEQ ID NO: 204869 - protein, 38 aa, Artificial Sequence
  Description of Artificial Sequence: Synthetic polypeptide
DEMCISCTNPVATEQYGCVCSNWGEDDNAENFNSDTQS

SEQ ID NO: 204870 - protein, 38 aa, Artificial Sequence
  Description of Artificial Sequence: Synthetic polypeptide
AEEEISTTNPVAYEGYGCVCSNWGEDHNAENFNSDTQS

SEQ ID NO: 204871 - protein, 36 aa, Artificial Sequence
  Description of Artificial Sequence: Synthetic polypeptide
EESEICSTNPVAYERYGVVVPVDGAVSLEDGGKERS

SEQ ID NO: 204872 - protein, 38 aa, Artificial Sequence
  Description of Artificial Sequence: Synthetic polypeptide
DESEIRCTNPVATEGWGQCVCSWGEDENQEYFGSDTQS

SEQ ID NO: 204873 - protein, 37 aa, Artificial Sequence
  Description of Artificial Sequence: Synthetic polypeptide
SEAEIATTNPVAYEGYGCVCSTWGEHNAEHFISETQA

SEQ ID NO: 204874 - protein, 34 aa, Artificial Sequence
  Description of Artificial Sequence: Synthetic polypeptide
TNNTEIATTNPVAYECWGIVYHGDDQAQDQNHEA

SEQ ID NO: 204875 - protein, 38 aa, Artificial Sequence
  Description of Artificial Sequence: Synthetic polypeptide
DENCIRTTNPVATEQWGCVCSNSGEDENAEYSISDTQS

SEQ ID NO: 204876 - protein, 38 aa, Artificial Sequence
  Description of Artificial Sequence: Synthetic polypeptide
AEEEISTTNPVAYEGYGCVCSNWEEDHNAENFNSDTQG

SEQ ID NO: 204877 - protein, 37 aa, Artificial Sequence
  Description of Artificial Sequence: Synthetic polypeptide
CEEEIACTNPVATEQYGSCAAAGPAEGAADSGSEEDA

SEQ ID NO: 204878 - protein, 38 aa, Artificial Sequence
  Description of Artificial Sequence: Synthetic polypeptide
AEECIATTNPVATEQYGCSCPNWGEADNAEHFISENQA

SEQ ID NO: 204879 - protein, 37 aa, Artificial Sequence
  Description of Artificial Sequence: Synthetic polypeptide
EEAAIATTNPVATEAYGSVCPHSCIAGHSGGHSIFDG

SEQ ID NO: 204880 - protein, 37 aa, Artificial Sequence
  Description of Artificial Sequence: Synthetic polypeptide
SEAEIACTNPVATEQWGCVAGPANALPSTMGHPMESG

SEQ ID NO: 204881 - protein, 38 aa, Artificial Sequence
  Description of Artificial Sequence: Synthetic polypeptide
AEEEISTTNPVAYEGYGCVCSNWEEDHNAENFNSDTQA

SEQ ID NO: 204882 - protein, 37 aa, Artificial Sequence
  Description of Artificial Sequence: Synthetic polypeptide
QESEIAPTNPCSYEQYGVTVSCWGHMLSQNSNGPSDR

SEQ ID NO: 204883 - protein, 38 aa, Artificial Sequence
  Description of Artificial Sequence: Synthetic polypeptide
DEAEIATTNPVATEGYGQVVCSNWGEDNAEYFPSDTQS

SEQ ID NO: 204884 - protein, 38 aa, Artificial Sequence
  Description of Artificial Sequence: Synthetic polypeptide
SEAEIACTNPVATEQYGCVAAITNPMGVNNAMLMGSDD

SEQ ID NO: 204885 - protein, 35 aa, Artificial Sequence
  Description of Artificial Sequence: Synthetic polypeptide
DDSEVASTNPVSTEGYGCVCGTWEHNAENFGSQQA

SEQ ID NO: 204886 - protein, 36 aa, Artificial Sequence
  Description of Artificial Sequence: Synthetic polypeptide
AEMEIACTNPCSYEQYGCVCSWGELNQESFNSETQS

SEQ ID NO: 204887 - protein, 38 aa, Artificial Sequence
  Description of Artificial Sequence: Synthetic polypeptide
AEEEISTTNPVAYEGYGCVCSNWEEDHNAENFNSDNQA

SEQ ID NO: 204888 - protein, 35 aa, Artificial Sequence
  Description of Artificial Sequence: Synthetic polypeptide
NETEIRTTNPIATECWGATTVANAEDWAEPKGPYI

SEQ ID NO: 204889 - protein, 36 aa, Artificial Sequence
  Description of Artificial Sequence: Synthetic polypeptide
QENEIATTNPVAYEPYGPNTVAGEHLQNHQMEMQLN

SEQ ID NO: 204890 - protein, 38 aa, Artificial Sequence
  Description of Artificial Sequence: Synthetic polypeptide
CDECISTTNPVATEQYGCVCSNWGEDHNAEYFNSDTQS

SEQ ID NO: 204891 - protein, 39 aa, Artificial Sequence
  Description of Artificial Sequence: Synthetic polypeptide
DEAEISTTNPVATEQYGQCVCSNWEEDHNAENFISDTQA

SEQ ID NO: 204892 - protein, 39 aa, Artificial Sequence
  Description of Artificial Sequence: Synthetic polypeptide
CDEEISTTNPVATEQYGQCVCSNWGPDHNEENFNSDTQS

SEQ ID NO: 204893 - protein, 37 aa, Artificial Sequence
  Description of Artificial Sequence: Synthetic polypeptide
SEAEIATTNPVAYEPPWGTSGGVEPVGQANQGDNSDA

SEQ ID NO: 204894 - protein, 37 aa, Artificial Sequence
  Description of Artificial Sequence: Synthetic polypeptide
DEESIATTNPVAYEPQWGHSACAAANGDAAAAGDQHQ

SEQ ID NO: 204895 - protein, 36 aa, Artificial Sequence
  Description of Artificial Sequence: Synthetic polypeptide
DESEIRTTNPVSTEPWGCIAPEDGQQQQQQRVTTIS

SEQ ID NO: 204896 - protein, 38 aa, Artificial Sequence
  Description of Artificial Sequence: Synthetic polypeptide
DENAISTTNPVAYEQYGCVCSNWGEDHNAEHFNSDNQS

SEQ ID NO: 204897 - protein, 39 aa, Artificial Sequence
  Description of Artificial Sequence: Synthetic polypeptide
DEAEISTTNPVATEQYGQCVCSDWGEDDNQEYFSSDTQS

SEQ ID NO: 204898 - protein, 38 aa, Artificial Sequence
  Description of Artificial Sequence: Synthetic polypeptide
DEAEISTTNPVAYEQYGQCVCGNWGEHNAENFNSETQA

SEQ ID NO: 204899 - protein, 38 aa, Artificial Sequence
  Description of Artificial Sequence: Synthetic polypeptide
VEDEIATTNPVAYEPWGHSVSAIADGALTQTNHGDSMA

SEQ ID NO: 204900 - protein, 38 aa, Artificial Sequence
  Description of Artificial Sequence: Synthetic polypeptide
DDEEISTTNPVATEGYGQCVCSNWGEHNAENFISDTQS

SEQ ID NO: 204901 - protein, 37 aa, Artificial Sequence
  Description of Artificial Sequence: Synthetic polypeptide
AEECISTTNPVAYEGYGCVCSNWGEHNAENFNSETQS

SEQ ID NO: 204902 - protein, 38 aa, Artificial Sequence
  Description of Artificial Sequence: Synthetic polypeptide
SAEEIATTNPVAYEQYGSVAACPGPAPEAGTPMEDLNW

SEQ ID NO: 204903 - protein, 39 aa, Artificial Sequence
  Description of Artificial Sequence: Synthetic polypeptide
DEAEIRTTNPVATEGWGQCVCSNWGEDENAEYFGSDTQS

SEQ ID NO: 204904 - protein, 37 aa, Artificial Sequence
  Description of Artificial Sequence: Synthetic polypeptide
AEEEIATTNPVATEAYGCYCPNWGEDNIEHFNSETQA

SEQ ID NO: 204905 - protein, 38 aa, Artificial Sequence
  Description of Artificial Sequence: Synthetic polypeptide
SECAEIATTNPVAYEQWGVCVQWETNNDTNRPGGGDSM

SEQ ID NO: 204906 - protein, 39 aa, Artificial Sequence
  Description of Artificial Sequence: Synthetic polypeptide
EEETVRTTNPVATEQYGSAVISEDPVSIYQVSPVAVETH

SEQ ID NO: 204907 - protein, 38 aa, Artificial Sequence
  Description of Artificial Sequence: Synthetic polypeptide
AEECISTTNPVAYEQYGQCVCSNWGEHNQESFNSDTQS

SEQ ID NO: 204908 - protein, 40 aa, Artificial Sequence
  Description of Artificial Sequence: Synthetic polypeptide
DENEIRTTNPVATEQYGAASCMCPAGVALLQEQVVQEDDS

SEQ ID NO: 204909 - protein, 35 aa, Artificial Sequence
  Description of Artificial Sequence: Synthetic polypeptide
ETNEIATTNPVAYEAWGVVWPGPNNENDEQMNGEM

SEQ ID NO: 204910 - protein, 38 aa, Artificial Sequence
  Description of Artificial Sequence: Synthetic polypeptide
CEACIRTTNPVAYEQYGQCVCSNWGEHNAENFNSDNQS

SEQ ID NO: 204911 - protein, 37 aa, Artificial Sequence
  Description of Artificial Sequence: Synthetic polypeptide
DEQEIACTNPVATASWGCVAATTGAHEAPTDQMEGNH

SEQ ID NO: 204912 - protein, 37 aa, Artificial Sequence
  Description of Artificial Sequence: Synthetic polypeptide
DEEEISTTNPCATEEYGCVCQWGEDHNAENFISDTAA

SEQ ID NO: 204913 - protein, 36 aa, Artificial Sequence
  Description of Artificial Sequence: Synthetic polypeptide
VEDEIACTNPVAYEQWGSICPAPNLGMEHQIDIQAM

SEQ ID NO: 204914 - protein, 39 aa, Artificial Sequence
  Description of Artificial Sequence: Synthetic polypeptide
AEECISTTNPVATEQYGQCVCSMWGEDHNAENFISDNQS

SEQ ID NO: 204915 - protein, 36 aa, Artificial Sequence
  Description of Artificial Sequence: Synthetic polypeptide
VEDEIACTNPVAYEQWGSICSADNIGEEHQIDIQAM

SEQ ID NO: 204916 - protein, 39 aa, Artificial Sequence
  Description of Artificial Sequence: Synthetic polypeptide
DENCISTTNPVATEQYGQCVCSNWGEDHNAENFNSDTQN

SEQ ID NO: 204917 - protein, 39 aa, Artificial Sequence
  Description of Artificial Sequence: Synthetic polypeptide
SEECIRTTNPVATEGYGQCVCSNWGEDDNAEHFNSDTQA

SEQ ID NO: 204918 - protein, 38 aa, Artificial Sequence
  Description of Artificial Sequence: Synthetic polypeptide
DEGVIACTNPVAYEQWGCSVIASTGNGENSAEMIGSKM

SEQ ID NO: 204919 - protein, 36 aa, Artificial Sequence
  Description of Artificial Sequence: Synthetic polypeptide
VEDEIACTNPVAYEQWGSICSAPNTGEEHQIDITAM

SEQ ID NO: 204920 - protein, 38 aa, Artificial Sequence
  Description of Artificial Sequence: Synthetic polypeptide
DEEEISTTNPCATEEYGQCVCQNWGEHNAEYFNSDTAA

SEQ ID NO: 204921 - protein, 39 aa, Artificial Sequence
  Description of Artificial Sequence: Synthetic polypeptide
DDECISTTNPVATEQYGQCVCSNWGEDDNAENFNSDTQG

SEQ ID NO: 204922 - protein, 39 aa, Artificial Sequence
  Description of Artificial Sequence: Synthetic polypeptide
DDECISTTNPVATEQYGQCVCSNWGEDHNAEGFNSDTQS

SEQ ID NO: 204923 - protein, 38 aa, Artificial Sequence
  Description of Artificial Sequence: Synthetic polypeptide
DEEEIATTNPVAYNQYGPCTIPNPNVGPQEASINEQTS

SEQ ID NO: 204924 - protein, 37 aa, Artificial Sequence
  Description of Artificial Sequence: Synthetic polypeptide
DEMEIRTTNPCATEGWGCQTCQNWEDDAENSGSDNIS

SEQ ID NO: 204925 - protein, 38 aa, Artificial Sequence
  Description of Artificial Sequence: Synthetic polypeptide
DEEEISTTNPCATEEYGCVCQNWGEDHNAEYFNSDNAA

SEQ ID NO: 204926 - protein, 37 aa, Artificial Sequence
  Description of Artificial Sequence: Synthetic polypeptide
DEDEIATTNPVAYEPWGRPVPAGQGPALQHQDGMSAK

SEQ ID NO: 204927 - protein, 36 aa, Artificial Sequence
  Description of Artificial Sequence: Synthetic polypeptide
DERCEAEIATTNPCVYEQWGCTVTLDNGEHGQGDTQ

SEQ ID NO: 204928 - protein, 39 aa, Artificial Sequence
  Description of Artificial Sequence: Synthetic polypeptide
ADAEIRTTNPVATEQYGQCVCSNWGEDHNAEGFNSETQS

SEQ ID NO: 204929 - protein, 39 aa, Artificial Sequence
  Description of Artificial Sequence: Synthetic polypeptide
DDMEIATTNPVATEQYGQCVCSNWMEDHNAEHFISENQA

SEQ ID NO: 204930 - protein, 38 aa, Artificial Sequence
  Description of Artificial Sequence: Synthetic polypeptide
VEDEIACTNPVAYEPWGSTVCANSNDNPQEHQDGNMAK

SEQ ID NO: 204931 - protein, 38 aa, Artificial Sequence
  Description of Artificial Sequence: Synthetic polypeptide
DEAEISTTNPVAYEGYGCVCSNWGEDDNEENFNSENQS

SEQ ID NO: 204932 - protein, 40 aa, Artificial Sequence
  Description of Artificial Sequence: Synthetic polypeptide
SEEEIKTTNPVATEGYGVVDVGVGTGNVGQQEGEEGEDTL

SEQ ID NO: 204933 - protein, 39 aa, Artificial Sequence
  Description of Artificial Sequence: Synthetic polypeptide
AEECISTTNPVAYEQYGQCVCSTWGEDHNAEGFNSDNQG

SEQ ID NO: 204934 - protein, 38 aa, Artificial Sequence
  Description of Artificial Sequence: Synthetic polypeptide
SECAEIATTNPVAYEAWGVCVQWETNNDTNRPGGGGRK

SEQ ID NO: 204935 - protein, 38 aa, Artificial Sequence
  Description of Artificial Sequence: Synthetic polypeptide
AEMEIACTNPVATEQYGQCSCSWGEDDNQEYFGSDTQA

SEQ ID NO: 204936 - protein, 35 aa, Artificial Sequence
  Description of Artificial Sequence: Synthetic polypeptide
VEDEIACTNPVAYEQWGCCASGAPGEATAHGDGEA

SEQ ID NO: 204937 - protein, 36 aa, Artificial Sequence
  Description of Artificial Sequence: Synthetic polypeptide
AEAEIACTNPVGTEGYGVSCGSGEDHNQHFGSDTQS

SEQ ID NO: 204938 - protein, 39 aa, Artificial Sequence
  Description of Artificial Sequence: Synthetic polypeptide
DDEEISTTNPVATEGYGQCVCSNWGEDHNIEGFNSDTQA

SEQ ID NO: 204939 - protein, 38 aa, Artificial Sequence
  Description of Artificial Sequence: Synthetic polypeptide
AEMEIACTNPVATEQYGQCSCSNWGEDNAEYFGSDTQS

SEQ ID NO: 204940 - protein, 36 aa, Artificial Sequence
  Description of Artificial Sequence: Synthetic polypeptide
NESNEIATTNPVAYEAWGVVWPGPNNENDSGQNGEM

SEQ ID NO: 204941 - protein, 39 aa, Artificial Sequence
  Description of Artificial Sequence: Synthetic polypeptide
CEACISTTNPVATEQYGQCVCSTWGEDHNQENFNSDTQA

SEQ ID NO: 204942 - protein, 36 aa, Artificial Sequence
  Description of Artificial Sequence: Synthetic polypeptide
VEDEIATTNPVAYEPWGTFACAAIAGELPDSGENGR

SEQ ID NO: 204943 - protein, 37 aa, Artificial Sequence
  Description of Artificial Sequence: Synthetic polypeptide
VEDEIACTNPVAYEQWGCSAATNPVLPADAGGGDDHL

SEQ ID NO: 204944 - protein, 39 aa, Artificial Sequence
  Description of Artificial Sequence: Synthetic polypeptide
AEECISTTNPVAYEQYGQCVCSNWMEPHNTENFNSDNQA

SEQ ID NO: 204945 - protein, 36 aa, Artificial Sequence
  Description of Artificial Sequence: Synthetic polypeptide
VEDEIACTNPVAYEQWGCVAAANGVEPMTAGGDNSL

SEQ ID NO: 204946 - protein, 36 aa, Artificial Sequence
  Description of Artificial Sequence: Synthetic polypeptide
SEECISCTNPCATEGYGCVCSWGEHNAENFGSDTQS

SEQ ID NO: 204947 - protein, 35 aa, Artificial Sequence
  Description of Artificial Sequence: Synthetic polypeptide
DDSEVASTNPVSYEGYGNTVACVTEISQSNTGGQR

SEQ ID NO: 204948 - protein, 37 aa, Artificial Sequence
  Description of Artificial Sequence: Synthetic polypeptide
DDECISTVNPVATEGYGCVCSNWGEHNEENFGSDTQS

SEQ ID NO: 204949 - protein, 38 aa, Artificial Sequence
  Description of Artificial Sequence: Synthetic polypeptide
SECAEIATTNPVAYEQWGTCVQWETNNDTNKPGGGNNM

SEQ ID NO: 204950 - protein, 38 aa, Artificial Sequence
  Description of Artificial Sequence: Synthetic polypeptide
SAEEIATTNPVAYEQYGSVAACPGPAPEAGTPMEDVRM

SEQ ID NO: 204951 - protein, 39 aa, Artificial Sequence
  Description of Artificial Sequence: Synthetic polypeptide
SEEEIATTNPVATEQYGQCSCPNWMEDDNAEHFISETQS

SEQ ID NO: 204952 - protein, 36 aa, Artificial Sequence
  Description of Artificial Sequence: Synthetic polypeptide
VEDEIACTNPVAYEQWGCVAGSGFEEATMGLGEPPK

SEQ ID NO: 204953 - protein, 36 aa, Artificial Sequence
  Description of Artificial Sequence: Synthetic polypeptide
VEDEIACTNPVAYEQWGCVAGTNGGAEAAPGDQTAQ

SEQ ID NO: 204954 - protein, 37 aa, Artificial Sequence
  Description of Artificial Sequence: Synthetic polypeptide
AEEEIASVNPVCTEQYGCVCSWGEAHNQESFNSDNQA

SEQ ID NO: 204955 - protein, 36 aa, Artificial Sequence
  Description of Artificial Sequence: Synthetic polypeptide
VEDEIACTNPVAYEQWGCVAGTNNLPEASPMDQEAE

SEQ ID NO: 204956 - protein, 38 aa, Artificial Sequence
  Description of Artificial Sequence: Synthetic polypeptide
SEEEIATTNPVATEQYGQCSCPWEEDDNQEHFISETQS

SEQ ID NO: 204957 - protein, 37 aa, Artificial Sequence
  Description of Artificial Sequence: Synthetic polypeptide
VEDEIACTNPVAYEQWGHCSAADNPLPADAGGGNDHL

SEQ ID NO: 204958 - protein, 38 aa, Artificial Sequence
  Description of Artificial Sequence: Synthetic polypeptide
DSEEISTTNPVGYEQWGCVCSNWGEDHNAENFGSDNQS

SEQ ID NO: 204959 - protein, 36 aa, Artificial Sequence
  Description of Artificial Sequence: Synthetic polypeptide
VEDEIACTNPVAYEQWGSVCADGPAGIPAPDPMENW

SEQ ID NO: 204960 - protein, 37 aa, Artificial Sequence
  Description of Artificial Sequence: Synthetic polypeptide
DEDEIATTNPVAYEPWGRPPPAGQGPALTHQDGMNAL

SEQ ID NO: 204961 - protein, 37 aa, Artificial Sequence
  Description of Artificial Sequence: Synthetic polypeptide
CEEEIACTNPVATAQWGCNTAGCGELPQANPQDGSNE

SEQ ID NO: 204962 - protein, 37 aa, Artificial Sequence
  Description of Artificial Sequence: Synthetic polypeptide
CEEEIACTNPVATAQWGCCFATNGQNPETLENGEEAS

SEQ ID NO: 204963 - protein, 38 aa, Artificial Sequence
  Description of Artificial Sequence: Synthetic polypeptide
DEMEISTTNPVAYEGYGQCVCSNWGEHNQENFNSDNQA

SEQ ID NO: 204964 - protein, 35 aa, Artificial Sequence
  Description of Artificial Sequence: Synthetic polypeptide
DDSEVASTNPVSTEGYGCVCGTWEDNQESFGSQQA

SEQ ID NO: 204965 - protein, 39 aa, Artificial Sequence
  Description of Artificial Sequence: Synthetic polypeptide
DEMCISTTNPVATEQYGICVCSNWGEDPNAENFNSDTQA

SEQ ID NO: 204966 - protein, 39 aa, Artificial Sequence
  Description of Artificial Sequence: Synthetic polypeptide
AEECISTTNPVATEQYGQCVCSNWGEDDNAENFNSDNQA

SEQ ID NO: 204967 - protein, 37 aa, Artificial Sequence
  Description of Artificial Sequence: Synthetic polypeptide
CEECISTTNPVAYEQYGCVCSNWGEHDIEHFNSDTQS

SEQ ID NO: 204968 - protein, 38 aa, Artificial Sequence
  Description of Artificial Sequence: Synthetic polypeptide
DDEEISTTNPVAYEQYGQCVCGNWGEHNAENFISDNQM

SEQ ID NO: 204969 - protein, 39 aa, Artificial Sequence
  Description of Artificial Sequence: Synthetic polypeptide
DDEEISTTNPVAYEQYGQCVCGTWGEDHNAENFTSDNQS

SEQ ID NO: 204970 - protein, 39 aa, Artificial Sequence
  Description of Artificial Sequence: Synthetic polypeptide
DDEEISTTNPVAYEQYGQCVCSMWGEDHNAEGFGSDTQS

SEQ ID NO: 204971 - protein, 38 aa, Artificial Sequence
  Description of Artificial Sequence: Synthetic polypeptide
DEMEIRTTNPCATEGWGCQTCGNAGEDNAEHSGSDNQS

SEQ ID NO: 204972 - protein, 38 aa, Artificial Sequence
  Description of Artificial Sequence: Synthetic polypeptide
SEECIATTNPVATEQYGCSCPTWMEDDNAEHFISETQS

SEQ ID NO: 204973 - protein, 39 aa, Artificial Sequence
  Description of Artificial Sequence: Synthetic polypeptide
DDEEISTTNPVAYEQYGQCVCSNSGEDHNQENFGSDTQA

SEQ ID NO: 204974 - protein, 35 aa, Artificial Sequence
  Description of Artificial Sequence: Synthetic polypeptide
DEREIATTNPIATECWGATYYANENDGHEKTGEQM

SEQ ID NO: 204975 - protein, 39 aa, Artificial Sequence
  Description of Artificial Sequence: Synthetic polypeptide
DDEEISTTNPVAYEQYGQCVCSNWEEDDNAEHFNSDTQS

SEQ ID NO: 204976 - protein, 37 aa, Artificial Sequence
  Description of Artificial Sequence: Synthetic polypeptide
DEEEIATTNPVAYAPWGHSACAAANGDTAYQGGDQHQ

SEQ ID NO: 204977 - protein, 36 aa, Artificial Sequence
  Description of Artificial Sequence: Synthetic polypeptide
DESEIRTTNPVSTEPWGCIAPEDGQQQQQQRETDKS

SEQ ID NO: 204978 - protein, 39 aa, Artificial Sequence
  Description of Artificial Sequence: Synthetic polypeptide
DDEEISTTNPVAYEQYGQCVCSNWEEDHNAENFGSDTQG

SEQ ID NO: 204979 - protein, 38 aa, Artificial Sequence
  Description of Artificial Sequence: Synthetic polypeptide
CDEEISTTNPVAYEQYGQCVCSNWGEPNAENFNSDTQM

SEQ ID NO: 204980 - protein, 36 aa, Artificial Sequence
  Description of Artificial Sequence: Synthetic polypeptide
DEDEIATTNPVAYEPWGRPPAGAGPALVHQDGMEAV

SEQ ID NO: 204981 - protein, 39 aa, Artificial Sequence
  Description of Artificial Sequence: Synthetic polypeptide
DDEEISTTNPVAYEQYGQCVCSNWEEDHNAEYFNSDTQL

SEQ ID NO: 204982 - protein, 37 aa, Artificial Sequence
  Description of Artificial Sequence: Synthetic polypeptide
SEECIACTNPVAYEQWGTNCSATLANAIAHPGDNQAM

SEQ ID NO: 204983 - protein, 35 aa, Artificial Sequence
  Description of Artificial Sequence: Synthetic polypeptide
AEMEIACTNPCSYEQYGCVCSWVEDNQSFGSETQS

SEQ ID NO: 204984 - protein, 36 aa, Artificial Sequence
  Description of Artificial Sequence: Synthetic polypeptide
VEDEIACTNPVAYEQWGTVPAANGEPMTAGGPNNSL

SEQ ID NO: 204985 - protein, 38 aa, Artificial Sequence
  Description of Artificial Sequence: Synthetic polypeptide
DEAEISTTNPVAYEGYGCVCSNWGEDHNAENFNSETQS

SEQ ID NO: 204986 - protein, 39 aa, Artificial Sequence
  Description of Artificial Sequence: Synthetic polypeptide
DDEEISTTNPVAYEQYGQCVCSNWEEDTNTENFISDTQS

SEQ ID NO: 204987 - protein, 39 aa, Artificial Sequence
  Description of Artificial Sequence: Synthetic polypeptide
DDEEISTTNPVAYEQYGQCVCSNWGADHNAEFFNSDTQS

SEQ ID NO: 204988 - protein, 37 aa, Artificial Sequence
  Description of Artificial Sequence: Synthetic polypeptide
CDEEISTTNPVAYEQYGCVCSNWGEHNAENFSSETQS

SEQ ID NO: 204989 - protein, 37 aa, Artificial Sequence
  Description of Artificial Sequence: Synthetic polypeptide
DEDEIATTNPVAYAPWGSTACAATAGELPDSASNPRL

SEQ ID NO: 204990 - protein, 39 aa, Artificial Sequence
  Description of Artificial Sequence: Synthetic polypeptide
DDEEISTTNPVAYEQYGQCVCSNWGEDDNTESFNSDTQA

SEQ ID NO: 204991 - protein, 37 aa, Artificial Sequence
  Description of Artificial Sequence: Synthetic polypeptide
AENEIACTNPVATEQYGCSCSWGEPDNQEYFISDTQS

SEQ ID NO: 204992 - protein, 39 aa, Artificial Sequence
  Description of Artificial Sequence: Synthetic polypeptide
DDEEISTTNPVAYEQYGQCVCSNWGEDHNAEGFISDNQA

SEQ ID NO: 204993 - protein, 36 aa, Artificial Sequence
  Description of Artificial Sequence: Synthetic polypeptide
VEDEIACTNPVAYEQWGTIAATPNEPDTAGIGNLHK

SEQ ID NO: 204994 - protein, 36 aa, Artificial Sequence
  Description of Artificial Sequence: Synthetic polypeptide
VEDEIACTNPVAYEQWGTIAATPNEPDTAGGPNMNM

SEQ ID NO: 204995 - protein, 38 aa, Artificial Sequence
  Description of Artificial Sequence: Synthetic polypeptide
AEAEISTTNPVATEQWGQCVCSNWGEHNQENFNSDTQS

SEQ ID NO: 204996 - protein, 35 aa, Artificial Sequence
  Description of Artificial Sequence: Synthetic polypeptide
VEDEIACTNPVAYEQWGSVCADGPAWITGDPMESQ

SEQ ID NO: 204997 - protein, 37 aa, Artificial Sequence
  Description of Artificial Sequence: Synthetic polypeptide
DEAVIGTTNPVATEGWGCVCSWGEDHNQEYFISDNQA

SEQ ID NO: 204998 - protein, 37 aa, Artificial Sequence
  Description of Artificial Sequence: Synthetic polypeptide
DEEEISTTNPCAYEEYGCVCGNWGEHNAENFISDNAA

SEQ ID NO: 204999 - protein, 37 aa, Artificial Sequence
  Description of Artificial Sequence: Synthetic polypeptide
SAEEIATTNPVATESYGCVAPGEGGHGNESGEEDGMN

SEQ ID NO: 205000 - protein, 37 aa, Artificial Sequence
  Description of Artificial Sequence: Synthetic polypeptide
DEEEIATTNPVAYAPWGHSFACAAANGLPQSAEVDDT

SEQ ID NO: 205001 - protein, 36 aa, Artificial Sequence
  Description of Artificial Sequence: Synthetic polypeptide
VEDEIACTNPVAYEQWGSVCNADGPAGIPRDPMESW

SEQ ID NO: 205002 - protein, 39 aa, Artificial Sequence
  Description of Artificial Sequence: Synthetic polypeptide
DDECISTTNPVATEQYGQCVCSNWGEDHNAEHFNSENQS

SEQ ID NO: 205003 - protein, 36 aa, Artificial Sequence
  Description of Artificial Sequence: Synthetic polypeptide
CEDEIATTNPVAYEPQWGCVAGNPGLPEATAEEEHH

SEQ ID NO: 205004 - protein, 38 aa, Artificial Sequence
  Description of Artificial Sequence: Synthetic polypeptide
AEECISTTNPVAYEQYGQCVCSNWGEHNAENFNSDTQA

SEQ ID NO: 205005 - protein, 38 aa, Artificial Sequence
  Description of Artificial Sequence: Synthetic polypeptide
DDECISTTNPVATEQYGQCVCSNWGEHNAENFISDTQS

SEQ ID NO: 205006 - protein, 38 aa, Artificial Sequence
  Description of Artificial Sequence: Synthetic polypeptide
AEECISTTNPVAYEQYGQCVCSNWGEDNAENFNSETQA

SEQ ID NO: 205007 - protein, 38 aa, Artificial Sequence
  Description of Artificial Sequence: Synthetic polypeptide
CDMEISTTNPVATEQYGCVCSNWGEDHNAENFNSDTQS

SEQ ID NO: 205008 - protein, 38 aa, Artificial Sequence
  Description of Artificial Sequence: Synthetic polypeptide
DEEEISTTNPCATEGYGQCCCSWGEDHNAEYFGSDTQS

SEQ ID NO: 205009 - protein, 39 aa, Artificial Sequence
  Description of Artificial Sequence: Synthetic polypeptide
DEEEISTTNPCATEGYGQCVCSNWGEDHNTENFNSDFQA

SEQ ID NO: 205010 - protein, 37 aa, Artificial Sequence
  Description of Artificial Sequence: Synthetic polypeptide
DEEVIATTNPVAYEQYGCTIPNPNVGPQEASIFEQTS

SEQ ID NO: 205011 - protein, 39 aa, Artificial Sequence
  Description of Artificial Sequence: Synthetic polypeptide
DDEEISTTNPVATEGYGQCVCSNWGEDHNAEYFNSDTQS

SEQ ID NO: 205012 - protein, 38 aa, Artificial Sequence
  Description of Artificial Sequence: Synthetic polypeptide
AEECISTTNPVATEGYGCVCSNWGEDHNAENFNSDNQA

SEQ ID NO: 205013 - protein, 39 aa, Artificial Sequence
  Description of Artificial Sequence: Synthetic polypeptide
AEECISTTNPVATEQYGQCVCSMWGEDHNAENFNSDFQI

SEQ ID NO: 205014 - protein, 36 aa, Artificial Sequence
  Description of Artificial Sequence: Synthetic polypeptide
DEAEIACTNPVATASWGAVCANQNPPVNTAGNPEGT

SEQ ID NO: 205015 - protein, 38 aa, Artificial Sequence
  Description of Artificial Sequence: Synthetic polypeptide
DEEEIATTNPVAYAPWGHSFACAAANGLPQPSEGVDDS

SEQ ID NO: 205016 - protein, 34 aa, Artificial Sequence
  Description of Artificial Sequence: Synthetic polypeptide
DEAEIACTNPVATAQWGTNCAAIDGHPMEFEIND

SEQ ID NO: 205017 - protein, 39 aa, Artificial Sequence
  Description of Artificial Sequence: Synthetic polypeptide
DEAEISTTNPVATEQYGQCVCSMWGEDHNQENFISDTQA

SEQ ID NO: 205018 - protein, 38 aa, Artificial Sequence
  Description of Artificial Sequence: Synthetic polypeptide
DENVEIATTNPVAYERWGSVACQQPNEEQGEQMGMDGS

SEQ ID NO: 205019 - protein, 39 aa, Artificial Sequence
  Description of Artificial Sequence: Synthetic polypeptide
AEECISTTNPVATEQYGQCVCSMWGEDHNAENFNSETQA

SEQ ID NO: 205020 - protein, 39 aa, Artificial Sequence
  Description of Artificial Sequence: Synthetic polypeptide
AEECISTTNPVATEQYGQCVCSNWEEDHNAENFNSDTQA

SEQ ID NO: 205021 - protein, 37 aa, Artificial Sequence
  Description of Artificial Sequence: Synthetic polypeptide
VEDEIACTNPVAYEQWGSVCSVAGAGNNEAAGTPGDD

SEQ ID NO: 205022 - protein, 39 aa, Artificial Sequence
  Description of Artificial Sequence: Synthetic polypeptide
DEECISTTNPVATEGYGQCVCSNWGEDDNAENFNSETQS

SEQ ID NO: 205023 - protein, 37 aa, Artificial Sequence
  Description of Artificial Sequence: Synthetic polypeptide
CEEEIACTNPVATEQWGSCAAAGNAEGASDSGSGEAA

SEQ ID NO: 205024 - protein, 39 aa, Artificial Sequence
  Description of Artificial Sequence: Synthetic polypeptide
AEECISTTNPVATEQYGQCVCSNWGEDDNAEFFNSETQS

SEQ ID NO: 205025 - protein, 38 aa, Artificial Sequence
  Description of Artificial Sequence: Synthetic polypeptide
DEELIATTNPVAYEQYGGCTIPNPNVGPQEASINEQTS

SEQ ID NO: 205026 - protein, 36 aa, Artificial Sequence
  Description of Artificial Sequence: Synthetic polypeptide
CEEEIACTNPVATEQWGGCCNAAAATEAIIDQEDQH

SEQ ID NO: 205027 - protein, 39 aa, Artificial Sequence
  Description of Artificial Sequence: Synthetic polypeptide
NEMEIRTTNPVAYEQYGQCVCSNWGEDHNAEFFNSDTQS

SEQ ID NO: 205028 - protein, 39 aa, Artificial Sequence
  Description of Artificial Sequence: Synthetic polypeptide
DEAEISTTNPVATEQYGQCVCSNWGEDHNAENFFSDTQA

SEQ ID NO: 205029 - protein, 37 aa, Artificial Sequence
  Description of Artificial Sequence: Synthetic polypeptide
DEDEIATTNPVAYAQWGSNCSANPALPGEHMIDLTAM

SEQ ID NO: 205030 - protein, 38 aa, Artificial Sequence
  Description of Artificial Sequence: Synthetic polypeptide
DEEEIATTNPVAYNQYGCTIPNPNVGPCQEASINEQTY

SEQ ID NO: 205031 - protein, 37 aa, Artificial Sequence
  Description of Artificial Sequence: Synthetic polypeptide
CDEEISCTNPVATEGYGCVCSNWGEHNAENFNSDFQS

SEQ ID NO: 205032 - protein, 35 aa, Artificial Sequence
  Description of Artificial Sequence: Synthetic polypeptide
TETEIRTTNPIATECWGATTWANAEDWAEPKRPYI

SEQ ID NO: 205033 - protein, 39 aa, Artificial Sequence
  Description of Artificial Sequence: Synthetic polypeptide
DEEAISTTNPVATEQYGQCVCSNWGEDHNQESFISDTQS

SEQ ID NO: 205034 - protein, 38 aa, Artificial Sequence
  Description of Artificial Sequence: Synthetic polypeptide
DESEISTTNPVATEGWGCVCSNWGEDDNAEYFGSDTQA

SEQ ID NO: 205035 - protein, 38 aa, Artificial Sequence
  Description of Artificial Sequence: Synthetic polypeptide
CDEEISCTNPVATEQYGQCVCSNWGEHNAENFGSDFQS

SEQ ID NO: 205036 - protein, 35 aa, Artificial Sequence
  Description of Artificial Sequence: Synthetic polypeptide
DEDEIATTNPVAYASWGHCNTAGNGHTNHQAEQHH

SEQ ID NO: 205037 - protein, 36 aa, Artificial Sequence
  Description of Artificial Sequence: Synthetic polypeptide
QEDEIRGTNCVATEAWGCVSAINGEGGDGEGEEMQT

SEQ ID NO: 205038 - protein, 38 aa, Artificial Sequence
  Description of Artificial Sequence: Synthetic polypeptide
SEDEIACTNPVATEQWGHSCSAMWPAGTNQGNPMEPVH

SEQ ID NO: 205039 - protein, 37 aa, Artificial Sequence
  Description of Artificial Sequence: Synthetic polypeptide
NEGAIRSTNPVATEQYGCACVNTEAVTDEIGEGDQQD

SEQ ID NO: 205040 - protein, 38 aa, Artificial Sequence
  Description of Artificial Sequence: Synthetic polypeptide
QEPEIGTTNPVATEAYGTVVSALDGGDEEEEEGGNFDI

SEQ ID NO: 205041 - protein, 38 aa, Artificial Sequence
  Description of Artificial Sequence: Synthetic polypeptide
DEACISTTNPVAYEQYGQCVCSWGEDHNAENFNSDFQS

SEQ ID NO: 205042 - protein, 32 aa, Artificial Sequence
  Description of Artificial Sequence: Synthetic polypeptide
QESEIASTNPIGTECYGATAAEDWAEPKGPYI

SEQ ID NO: 205043 - protein, 38 aa, Artificial Sequence
  Description of Artificial Sequence: Synthetic polypeptide
DESEISTTNPVATEGWGQCVCSWGEDENAEYFGSDTQA

SEQ ID NO: 205044 - protein, 36 aa, Artificial Sequence
  Description of Artificial Sequence: Synthetic polypeptide
DEHEIRTTNPIATECWGATTWENAEDWAEPMGQYIE

SEQ ID NO: 205045 - protein, 39 aa, Artificial Sequence
  Description of Artificial Sequence: Synthetic polypeptide
DDEEISTTNPVATEGYGQCVCSNWGEDHNAEFFPSDNQS

SEQ ID NO: 205046 - protein, 38 aa, Artificial Sequence
  Description of Artificial Sequence: Synthetic polypeptide
DEECISTTNPVATEGYGICVCSWGEDDNAENFISDTQS

SEQ ID NO: 205047 - protein, 39 aa, Artificial Sequence
  Description of Artificial Sequence: Synthetic polypeptide
DEMCISTTNPVATEQYGQCVCSNWGEDHNAENFNSETQA

SEQ ID NO: 205048 - protein, 38 aa, Artificial Sequence
  Description of Artificial Sequence: Synthetic polypeptide
DDAEISTTNPVAYEQYGQCVCSNWGEHNAENFGSETQS

SEQ ID NO: 205049 - protein, 36 aa, Artificial Sequence
  Description of Artificial Sequence: Synthetic polypeptide
DEHEIRTTNPIATECWGATTWANAEDWWAEPKGPYI

SEQ ID NO: 205050 - protein, 38 aa, Artificial Sequence
  Description of Artificial Sequence: Synthetic polypeptide
AEECISTTNPVAYEGYGQCVCSTWGEHNIENFNSDTQS

SEQ ID NO: 205051 - protein, 39 aa, Artificial Sequence
  Description of Artificial Sequence: Synthetic polypeptide
DDAEISTTNPVAYEQYGQCVCSNWGEDTNAEYFNSETQA

SEQ ID NO: 205052 - protein, 37 aa, Artificial Sequence
  Description of Artificial Sequence: Synthetic polypeptide
DEMVIGTTNPVAYEQWGCVCSWGEDHNQEYFNSDNQA

SEQ ID NO: 205053 - protein, 36 aa, Artificial Sequence
  Description of Artificial Sequence: Synthetic polypeptide
VEDEIATTNPVAYEQWGSNAIANHADENTGGMGEQN

SEQ ID NO: 205054 - protein, 39 aa, Artificial Sequence
  Description of Artificial Sequence: Synthetic polypeptide
DDEEISTTNPVATEGYGQCVCSNWGEDDNIENFNSDNQI

SEQ ID NO: 205055 - protein, 36 aa, Artificial Sequence
  Description of Artificial Sequence: Synthetic polypeptide
DEDEIATTNPVAYAPWGTACAATAGELPDSASNGRE

SEQ ID NO: 205056 - protein, 35 aa, Artificial Sequence
  Description of Artificial Sequence: Synthetic polypeptide
VEDEIATTNPVAYAQWGTSACAAANGDAMQGDQHQ

SEQ ID NO: 205057 - protein, 37 aa, Artificial Sequence
  Description of Artificial Sequence: Synthetic polypeptide
SEDEIACTNPVATEQWGHSVNANAGAPTNNMGSEDMK

SEQ ID NO: 205058 - protein, 36 aa, Artificial Sequence
  Description of Artificial Sequence: Synthetic polypeptide
AEAEIASTNPVGYEAYGQVVMAYSPGLSQVHVGDID

SEQ ID NO: 205059 - protein, 41 aa, Artificial Sequence
  Description of Artificial Sequence: Synthetic polypeptide
EPFEELISRTTLNPDVATEWSNYGGPKVSINNKDQRRNINK

SEQ ID NO: 205060 - protein, 39 aa, Artificial Sequence
  Description of Artificial Sequence: Synthetic polypeptide
CDEEIRTTNPVAYEQYGQCVCGTWGEDHNAEYFNSETQS

SEQ ID NO: 205061 - protein, 38 aa, Artificial Sequence
  Description of Artificial Sequence: Synthetic polypeptide
DEACISTTNPVAYEQYGCVCSNWEEDHNAENFNSDTQA

SEQ ID NO: 205062 - protein, 38 aa, Artificial Sequence
  Description of Artificial Sequence: Synthetic polypeptide
CEEEISTTNPVAYEGYGCVCSNWMEDHNAENFNSDNQS

SEQ ID NO: 205063 - protein, 34 aa, Artificial Sequence
  Description of Artificial Sequence: Synthetic polypeptide
TETEIASTNPVGTEAWGVCAPTDRDQHQGQHDTD

SEQ ID NO: 205064 - protein, 37 aa, Artificial Sequence
  Description of Artificial Sequence: Synthetic polypeptide
DEECISTTNPCATEEYGQCVCGWGEHNAENFGSDTAA

SEQ ID NO: 205065 - protein, 38 aa, Artificial Sequence
  Description of Artificial Sequence: Synthetic polypeptide
AENEIACTNPVATEQYGCQSCSNWGEDNAEYFGSDTQS

SEQ ID NO: 205066 - protein, 37 aa, Artificial Sequence
  Description of Artificial Sequence: Synthetic polypeptide
DESEISTTNPVATCGYGCVCSNWGEDNQEYFTSDTQS

SEQ ID NO: 205067 - protein, 36 aa, Artificial Sequence
  Description of Artificial Sequence: Synthetic polypeptide
DEIAIGTTNPVATEQYGCLFKATDGSPVEFETSDKQ

SEQ ID NO: 205068 - protein, 38 aa, Artificial Sequence
  Description of Artificial Sequence: Synthetic polypeptide
AENEIACTNPVATEQYGCQSCSNWMEDNAEYFNSDNQA

SEQ ID NO: 205069 - protein, 39 aa, Artificial Sequence
  Description of Artificial Sequence: Synthetic polypeptide
DEMCISTTNPVATEQYGQCVCSNWGEDHNAENFNSDNQS

SEQ ID NO: 205070 - protein, 39 aa, Artificial Sequence
  Description of Artificial Sequence: Synthetic polypeptide
CDEEIRTTNPVAYEQYGQCVCSNWGEDHNAENFGSDTQS

SEQ ID NO: 205071 - protein, 35 aa, Artificial Sequence
  Description of Artificial Sequence: Synthetic polypeptide
QENEIATTNPVAYAPWGNTVAGEGHLNQNHMNMQM

SEQ ID NO: 205072 - protein, 38 aa, Artificial Sequence
  Description of Artificial Sequence: Synthetic polypeptide
CDEEISTTNPVATCQYGCVCSNWGEDHNAENFNSDFQA

SEQ ID NO: 205073 - protein, 38 aa, Artificial Sequence
  Description of Artificial Sequence: Synthetic polypeptide
DEEEIACTNPVATEQYGSACAAPEPAGGFAHQGDEEAM

SEQ ID NO: 205074 - protein, 39 aa, Artificial Sequence
  Description of Artificial Sequence: Synthetic polypeptide
AEAEISTTNPVATEQYGQCVCSNWEEDDNTENFISETQS

SEQ ID NO: 205075 - protein, 39 aa, Artificial Sequence
  Description of Artificial Sequence: Synthetic polypeptide
QEPEICTTNPVATEQYGAIVTDNFNQMDQQAEEGGQDGQ

SEQ ID NO: 205076 - protein, 39 aa, Artificial Sequence
  Description of Artificial Sequence: Synthetic polypeptide
AEAEISTTNPVATEQYGQCVCSNSGEDHNAEYFNSDTQS

SEQ ID NO: 205077 - protein, 39 aa, Artificial Sequence
  Description of Artificial Sequence: Synthetic polypeptide
DEECISTTNPVATEGYGQCVCGTSGEDHNAENFNSDTQS

SEQ ID NO: 205078 - protein, 39 aa, Artificial Sequence
  Description of Artificial Sequence: Synthetic polypeptide
DDEEISTTNPVATEGYGQCVCSNWGEDHNAEGFNSDTQS

SEQ ID NO: 205079 - protein, 37 aa, Artificial Sequence
  Description of Artificial Sequence: Synthetic polypeptide
VEDEIATTNPVAYEQWGTFACAAAAGELPDSGENGRM

SEQ ID NO: 205080 - protein, 38 aa, Artificial Sequence
  Description of Artificial Sequence: Synthetic polypeptide
DEMCISCTNPVATEQYGCVCSNWGEDPNAENFGSDTQA

SEQ ID NO: 205081 - protein, 38 aa, Artificial Sequence
  Description of Artificial Sequence: Synthetic polypeptide
AENEIACTNPVATEQYGCSCGNWGEADNAEYFGSDNQA

SEQ ID NO: 205082 - protein, 36 aa, Artificial Sequence
  Description of Artificial Sequence: Synthetic polypeptide
AENEIACTNPVATEQYGCSCQNWGEDNAEYFISDQS

SEQ ID NO: 205083 - protein, 36 aa, Artificial Sequence
  Description of Artificial Sequence: Synthetic polypeptide
ECTEIATTNPVAYEPWGVVASGEGNHQGQRQQDDTG

SEQ ID NO: 205084 - protein, 37 aa, Artificial Sequence
  Description of Artificial Sequence: Synthetic polypeptide
SEEEIATTNPVAYEGYGCSCPNWGEDNIEHFSSENQA

SEQ ID NO: 205085 - protein, 39 aa, Artificial Sequence
  Description of Artificial Sequence: Synthetic polypeptide
DECEICTTNPVATEAYGTVVTVTQQQNATEQGTTTQEEE

SEQ ID NO: 205086 - protein, 39 aa, Artificial Sequence
  Description of Artificial Sequence: Synthetic polypeptide
SEEEICCTNPVATEQYGCSVYIAAYAEEQQEGEFDSLQS

SEQ ID NO: 205087 - protein, 39 aa, Artificial Sequence
  Description of Artificial Sequence: Synthetic polypeptide
DEMCISTTNPVATEQYGQCVCSNWGEDHNAENFNSDTQS

SEQ ID NO: 205088 - protein, 36 aa, Artificial Sequence
  Description of Artificial Sequence: Synthetic polypeptide
DEICTCEIATTNPCVYEQWGCTVTLDLGEHGQNNTN

SEQ ID NO: 205089 - protein, 36 aa, Artificial Sequence
  Description of Artificial Sequence: Synthetic polypeptide
DEMEIRTTNPIATECWGATTWANAEDWEEPQIPQIE

SEQ ID NO: 205090 - protein, 38 aa, Artificial Sequence
  Description of Artificial Sequence: Synthetic polypeptide
AEAEISTTNPVATEGYGQCVCSWGEDHNAENFNSDFQS

SEQ ID NO: 205091 - protein, 38 aa, Artificial Sequence
  Description of Artificial Sequence: Synthetic polypeptide
DEACISTTNPVAYEQYGQCVCSNWGEHNAENFNSDNQA

SEQ ID NO: 205092 - protein, 38 aa, Artificial Sequence
  Description of Artificial Sequence: Synthetic polypeptide
DEACISTTNPVAYEQYGQCVCSNWGEHNAEGFNSDTQS

SEQ ID NO: 205093 - protein, 36 aa, Artificial Sequence
  Description of Artificial Sequence: Synthetic polypeptide
QEDEIATTNPVATASWGGCNVAGTGQLDNIMGGELH

SEQ ID NO: 205094 - protein, 38 aa, Artificial Sequence
  Description of Artificial Sequence: Synthetic polypeptide
CDEEISTTNPVATEQYGCVCQNWGEDHNAENFNSDNQA

SEQ ID NO: 205095 - protein, 39 aa, Artificial Sequence
  Description of Artificial Sequence: Synthetic polypeptide
DEEAISTTNPVATEQYGQCVCPNWGEDHNAENFISDTQA

SEQ ID NO: 205096 - protein, 38 aa, Artificial Sequence
  Description of Artificial Sequence: Synthetic polypeptide
CDEEISTTNPVATEGYGQCVCSNWGEHNAEHFNSDTQS

SEQ ID NO: 205097 - protein, 39 aa, Artificial Sequence
  Description of Artificial Sequence: Synthetic polypeptide
AEAEISTTNPVATEQYGQCQVCSNWGEHNAENFNSDTQP

SEQ ID NO: 205098 - protein, 36 aa, Artificial Sequence
  Description of Artificial Sequence: Synthetic polypeptide
DENCIRTTNPVSYEGYGCICSWEEDNQENFGSDTQS

SEQ ID NO: 205099 - protein, 37 aa, Artificial Sequence
  Description of Artificial Sequence: Synthetic polypeptide
QEEEIATTNPVATEQWGGCCAAQAIPDNTAAPGEGPH

SEQ ID NO: 205100 - protein, 39 aa, Artificial Sequence
  Description of Artificial Sequence: Synthetic polypeptide
DEACISTTNPVAYEQYGQCVCQNSGEDHNTENFNSDNQA

SEQ ID NO: 205101 - protein, 40 aa, Artificial Sequence
  Description of Artificial Sequence: Synthetic polypeptide
CEEEISTTNPVATEQYGQCQVCSMWGEDDNQENFNSDTQA

SEQ ID NO: 205102 - protein, 37 aa, Artificial Sequence
  Description of Artificial Sequence: Synthetic polypeptide
DEECISTTNPEAYEQYGCVCPNWGEHNAEYFISDTQA

SEQ ID NO: 205103 - protein, 38 aa, Artificial Sequence
  Description of Artificial Sequence: Synthetic polypeptide
AENEIACTNPVATEQYGCSCSNWMEDDNAEYFISDNQA

SEQ ID NO: 205104 - protein, 32 aa, Artificial Sequence
  Description of Artificial Sequence: Synthetic polypeptide
QESEIASTNPIGTEGWGATANSDWAEPKGPYI

SEQ ID NO: 205105 - protein, 35 aa, Artificial Sequence
  Description of Artificial Sequence: Synthetic polypeptide
AETEIATTNPIATECWGATYYANENDQAEKTGKTM

SEQ ID NO: 205106 - protein, 39 aa, Artificial Sequence
  Description of Artificial Sequence: Synthetic polypeptide
CDEEISTTNPVATEQYGCQVCSNWGEDHNAENFGSDFQS

SEQ ID NO: 205107 - protein, 39 aa, Artificial Sequence
  Description of Artificial Sequence: Synthetic polypeptide
DEECISTTNPVATCQYGQCVCSNWEEDHNAENFNSDTQS

SEQ ID NO: 205108 - protein, 37 aa, Artificial Sequence
  Description of Artificial Sequence: Synthetic polypeptide
DENCIRTTNPVSYEGYGCICSNWEEHNAENFGSDNQA

SEQ ID NO: 205109 - protein, 38 aa, Artificial Sequence
  Description of Artificial Sequence: Synthetic polypeptide
DEDEIATTNPVAYEQWGHCIIFAGNSGLVDNDGENDAE

SEQ ID NO: 205110 - protein, 35 aa, Artificial Sequence
  Description of Artificial Sequence: Synthetic polypeptide
TEVSIAATNPVAYDPWGIVPSCIASEHSQRSGENQ

SEQ ID NO: 205111 - protein, 39 aa, Artificial Sequence
  Description of Artificial Sequence: Synthetic polypeptide
DDEEISTTNPVATEGYGQCVCSNWGEDHNAEFFNSDTQA

SEQ ID NO: 205112 - protein, 37 aa, Artificial Sequence
  Description of Artificial Sequence: Synthetic polypeptide
DEEEIATTNPVAYEQYYCTIPNPNVGPCEASIHEQTS

SEQ ID NO: 205113 - protein, 38 aa, Artificial Sequence
  Description of Artificial Sequence: Synthetic polypeptide
CEEEISTTNPVAYEGYGQCVCSNWGEDNAENFNSDTQA

SEQ ID NO: 205114 - protein, 39 aa, Artificial Sequence
  Description of Artificial Sequence: Synthetic polypeptide
DEAEISTTNPVAYEQYGQCQVCSNWGEHNAENFNSDNQA

SEQ ID NO: 205115 - protein, 39 aa, Artificial Sequence
  Description of Artificial Sequence: Synthetic polypeptide
DEECISTTNPVATEAYGQCVCSNWGEDHNAENFNSDTQS

SEQ ID NO: 205116 - protein, 39 aa, Artificial Sequence
  Description of Artificial Sequence: Synthetic polypeptide
DENEIRTTNPVATEIYGAASCMCAGVDLLQEQVVQEDDS

SEQ ID NO: 205117 - protein, 38 aa, Artificial Sequence
  Description of Artificial Sequence: Synthetic polypeptide
DEACISTTNPVAYEQYGQCVCSNSGEHNAENFNSDNQA

SEQ ID NO: 205118 - protein, 38 aa, Artificial Sequence
  Description of Artificial Sequence: Synthetic polypeptide
CEEEISTTNPVAYEGYGQCVCSNWGEHNAESFNSDTQM

SEQ ID NO: 205119 - protein, 35 aa, Artificial Sequence
  Description of Artificial Sequence: Synthetic polypeptide
QENEIATTNPVAYAPWGTNTVAGEGHLQNHMNMKV

SEQ ID NO: 205120 - protein, 35 aa, Artificial Sequence
  Description of Artificial Sequence: Synthetic polypeptide
SEEAIAATNPVAYERWGCAATWGQQIDQGGHNGQK

SEQ ID NO: 205121 - protein, 38 aa, Artificial Sequence
  Description of Artificial Sequence: Synthetic polypeptide
DEDEIRTTNPVATDFYGAVVDGVGGIGDQALNIENGDD

SEQ ID NO: 205122 - protein, 36 aa, Artificial Sequence
  Description of Artificial Sequence: Synthetic polypeptide
DEHEIRTTNPIATECWGATTWANAEDWAEPKGPPYI

SEQ ID NO: 205123 - protein, 39 aa, Artificial Sequence
  Description of Artificial Sequence: Synthetic polypeptide
CEEEISTTNPVATEQYGQCAVCGNWGEHNQENFISDTQS

SEQ ID NO: 205124 - protein, 39 aa, Artificial Sequence
  Description of Artificial Sequence: Synthetic polypeptide
DDEEISTTNPVATEGYGQCVCSNWGEDDNTENFNSDTQS

SEQ ID NO: 205125 - protein, 38 aa, Artificial Sequence
  Description of Artificial Sequence: Synthetic polypeptide
CDEEISTTNPVATEGYGCVCSMSGEPHNAENFNSDTQA

SEQ ID NO: 205126 - protein, 36 aa, Artificial Sequence
  Description of Artificial Sequence: Synthetic polypeptide
DEMEIRTTNPIATECWGATTWANAEDWTAEPKGPYI

SEQ ID NO: 205127 - protein, 38 aa, Artificial Sequence
  Description of Artificial Sequence: Synthetic polypeptide
AEECISTTNPVAYEQYGCVCSNWGEDHNAEGFNSDNQS

SEQ ID NO: 205128 - protein, 39 aa, Artificial Sequence
  Description of Artificial Sequence: Synthetic polypeptide
DEECISCTNPVATEQYGQCVCSNWGEDHNQESFNSDTQA

SEQ ID NO: 205129 - protein, 38 aa, Artificial Sequence
  Description of Artificial Sequence: Synthetic polypeptide
AENEIACTNPVATEQYGCSCSNWGEDDNAEYFNSQTQA

SEQ ID NO: 205130 - protein, 34 aa, Artificial Sequence
  Description of Artificial Sequence: Synthetic polypeptide
AEAEIASTNPVGYEAYGQVVMAYDPGHSQHVGDI

SEQ ID NO: 205131 - protein, 39 aa, Artificial Sequence
  Description of Artificial Sequence: Synthetic polypeptide
DEEEIACTNPVAYEQYGSTVCAVIEAGGAAASGGDNMAH

SEQ ID NO: 205132 - protein, 38 aa, Artificial Sequence
  Description of Artificial Sequence: Synthetic polypeptide
CEEEISTTNPVAYEQYGCVCGNWGEDHNAENFNSDNQA

SEQ ID NO: 205133 - protein, 39 aa, Artificial Sequence
  Description of Artificial Sequence: Synthetic polypeptide
DEMAISTTNPVATEQYGQCVCSNSGEDHNAENFNSDTQD

SEQ ID NO: 205134 - protein, 39 aa, Artificial Sequence
  Description of Artificial Sequence: Synthetic polypeptide
DEMCISTTNPVATEQYGQCVCSNWGEDHNEENFNSDTQM

SEQ ID NO: 205135 - protein, 38 aa, Artificial Sequence
  Description of Artificial Sequence: Synthetic polypeptide
CEEEIACTNPVATEQWGHCYFATNGQNPETLENGEEAS

SEQ ID NO: 205136 - protein, 37 aa, Artificial Sequence
  Description of Artificial Sequence: Synthetic polypeptide
TETEISTTNPVAYECYGTVQACTGYEGQQNKFGGQME

SEQ ID NO: 205137 - protein, 38 aa, Artificial Sequence
  Description of Artificial Sequence: Synthetic polypeptide
AEAEISTTNPVATEQYGQCVCGNWGEHNAENFNSDFQA

SEQ ID NO: 205138 - protein, 39 aa, Artificial Sequence
  Description of Artificial Sequence: Synthetic polypeptide
DEMCISTTNPVATEQYGQCVCSNWGEDHNIENFNSDNQA

SEQ ID NO: 205139 - protein, 38 aa, Artificial Sequence
  Description of Artificial Sequence: Synthetic polypeptide
TETEIRTTNPVATEWYGQAWITYNTDPGQDLEIIDYQE

SEQ ID NO: 205140 - protein, 38 aa, Artificial Sequence
  Description of Artificial Sequence: Synthetic polypeptide
CDEEISTTNPVATEGYGCVCSNWGEDHNAENFNSDNQA

SEQ ID NO: 205141 - protein, 39 aa, Artificial Sequence
  Description of Artificial Sequence: Synthetic polypeptide
DDEEISTTNPVATEQWGQCVCSNWGPDHNAENFNSDTQS

SEQ ID NO: 205142 - protein, 39 aa, Artificial Sequence
  Description of Artificial Sequence: Synthetic polypeptide
DEECISCTNPVATEGYGQCVCSNWGEDTNAENFNSETQA

SEQ ID NO: 205143 - protein, 39 aa, Artificial Sequence
  Description of Artificial Sequence: Synthetic polypeptide
DEEAISTTNPVATEQYGQCVCSNWEEDHNAENFISDTQS

SEQ ID NO: 205144 - protein, 37 aa, Artificial Sequence
  Description of Artificial Sequence: Synthetic polypeptide
CDEEISTTNPVATEGYGCVCSNWGEHNQENFISDFQS

SEQ ID NO: 205145 - protein, 38 aa, Artificial Sequence
  Description of Artificial Sequence: Synthetic polypeptide
DEACISTTNPVAYEQYGQCVCSNWGEHNQEHFNSDFQS

SEQ ID NO: 205146 - protein, 38 aa, Artificial Sequence
  Description of Artificial Sequence: Synthetic polypeptide
DEACISTTNPVAYEQYGQCVCSNWGEHNAENFNSDTQS

SEQ ID NO: 205147 - protein, 38 aa, Artificial Sequence
  Description of Artificial Sequence: Synthetic polypeptide
CDEEISTTNPVATEGYGQCVCSNWEEHNAENFNSDTQA

SEQ ID NO: 205148 - protein, 38 aa, Artificial Sequence
  Description of Artificial Sequence: Synthetic polypeptide
AEAEISTTNPVATEQYGQCVCGNWGEHNAENFISETQS

SEQ ID NO: 205149 - protein, 39 aa, Artificial Sequence
  Description of Artificial Sequence: Synthetic polypeptide
CEEEISTTNPVATEQYGQCVCSNWGEDDNAENFFSETQS

SEQ ID NO: 205150 - protein, 37 aa, Artificial Sequence
  Description of Artificial Sequence: Synthetic polypeptide
QEPEIRGTNCVATEQYGAIIIVDQGGDENEDGEGQGT

SEQ ID NO: 205151 - protein, 38 aa, Artificial Sequence
  Description of Artificial Sequence: Synthetic polypeptide
AENEIACTNPVATEQYGCSCSNWGEDDNQENFNSQTQS

SEQ ID NO: 205152 - protein, 38 aa, Artificial Sequence
  Description of Artificial Sequence: Synthetic polypeptide
SEEEIATTNPVAYAPWGHSASAAGGPLDQDAGQNQDEE

SEQ ID NO: 205153 - protein, 38 aa, Artificial Sequence
  Description of Artificial Sequence: Synthetic polypeptide
DEECISCTNPVATEGYGQCVCSNWGEHNAENFNSETQS

SEQ ID NO: 205154 - protein, 39 aa, Artificial Sequence
  Description of Artificial Sequence: Synthetic polypeptide
DEECISTTNPVATEGYGQCVCSDWGEDHNAEFFNSENQA

SEQ ID NO: 205155 - protein, 39 aa, Artificial Sequence
  Description of Artificial Sequence: Synthetic polypeptide
AEAEISTTNPVATEQYGQCVCSNWGEDPNAENFNSDPQS

SEQ ID NO: 205156 - protein, 35 aa, Artificial Sequence
  Description of Artificial Sequence: Synthetic polypeptide
AEAEIASTNPVGYEADGQVVMAYSPGLSQHVGDIT

SEQ ID NO: 205157 - protein, 35 aa, Artificial Sequence
  Description of Artificial Sequence: Synthetic polypeptide
DDSEVASTNPVSTEGYGCVCQNWEINQEHFNSQQM

SEQ ID NO: 205158 - protein, 36 aa, Artificial Sequence
  Description of Artificial Sequence: Synthetic polypeptide
DDSEVASTNPVSTEGYGCVCQNWEPNQERFGSQTQA

SEQ ID NO: 205159 - protein, 39 aa, Artificial Sequence
  Description of Artificial Sequence: Synthetic polypeptide
CEECISTTNPVATEQYGQCVCSNWGEAHNAENFISDNQA

SEQ ID NO: 205160 - protein, 39 aa, Artificial Sequence
  Description of Artificial Sequence: Synthetic polypeptide
AEAEISTTNPVATEQYGQCVCSNWGEDHNAEYFNSETQS

SEQ ID NO: 205161 - protein, 39 aa, Artificial Sequence
  Description of Artificial Sequence: Synthetic polypeptide
AEECISTTNPVATEQYGQCVCSNWGEDHNAENFNSDNQM

SEQ ID NO: 205162 - protein, 39 aa, Artificial Sequence
  Description of Artificial Sequence: Synthetic polypeptide
AEECISTTNPVATEQYGQCVCSNWGEDHNAENFNSDTQS

SEQ ID NO: 205163 - protein, 39 aa, Artificial Sequence
  Description of Artificial Sequence: Synthetic polypeptide
DENCIRTTNPVATEQWGQCVTSNWGADHNAEYFNSDNAA

SEQ ID NO: 205164 - protein, 39 aa, Artificial Sequence
  Description of Artificial Sequence: Synthetic polypeptide
DDEEISTTNPVATEGYGQCVCSDWGEEHNAENFNSDNQS

SEQ ID NO: 205165 - protein, 39 aa, Artificial Sequence
  Description of Artificial Sequence: Synthetic polypeptide
DEEAISTTNPVAYEQYGQCVCSTWGEDHNAENFISETQS

SEQ ID NO: 205166 - protein, 39 aa, Artificial Sequence
  Description of Artificial Sequence: Synthetic polypeptide
AEAEISTTNPVATEQYGQCVCSNWGEDHNAEYFNSDTQS

SEQ ID NO: 205167 - protein, 35 aa, Artificial Sequence
  Description of Artificial Sequence: Synthetic polypeptide
QEDEIATTNPVAYEWYGEHAPWCEHEFSQHAEGEA

SEQ ID NO: 205168 - protein, 35 aa, Artificial Sequence
  Description of Artificial Sequence: Synthetic polypeptide
DDSEVASTNPVSTEGYGCVCQNSGEIQEYFGSQTQ

SEQ ID NO: 205169 - protein, 39 aa, Artificial Sequence
  Description of Artificial Sequence: Synthetic polypeptide
DEEAISTTNPVAYEQYGQCVCSNWGEDHNAENFNSDTQA

SEQ ID NO: 205170 - protein, 39 aa, Artificial Sequence
  Description of Artificial Sequence: Synthetic polypeptide
AEECISTTNPVATEQYGQCVCSNWGYDHNAENFNSDTQS

SEQ ID NO: 205171 - protein, 38 aa, Artificial Sequence
  Description of Artificial Sequence: Synthetic polypeptide
DEAEIGTTNPVAYEQYGCICSNWGEDDNEEYFNSDTQS

SEQ ID NO: 205172 - protein, 38 aa, Artificial Sequence
  Description of Artificial Sequence: Synthetic polypeptide
DDEEISTTNPVATEQWGCVTSNWGEDHNAENFSSDTAS

SEQ ID NO: 205173 - protein, 39 aa, Artificial Sequence
  Description of Artificial Sequence: Synthetic polypeptide
DEEAISTTNPVAYEQYGQCVCSNWEEDDNAENFNSDTQP

SEQ ID NO: 205174 - protein, 39 aa, Artificial Sequence
  Description of Artificial Sequence: Synthetic polypeptide
DEECISTTNPVATEGYGQCVCSMWGEDHNAENFNSDTQS

SEQ ID NO: 205175 - protein, 38 aa, Artificial Sequence
  Description of Artificial Sequence: Synthetic polypeptide
DEDEIATTNPVATEQWGGCTAGNAALLTATDDSAENQD

SEQ ID NO: 205176 - protein, 39 aa, Artificial Sequence
  Description of Artificial Sequence: Synthetic polypeptide
DEEAISTTNPVAYEQYGQCVCSNSGEDHNAENFGSDTQA

SEQ ID NO: 205177 - protein, 39 aa, Artificial Sequence
  Description of Artificial Sequence: Synthetic polypeptide
DEEAISTTNPVAYEQYGQCVCSMWGEDDNAEFFNSDTQS

SEQ ID NO: 205178 - protein, 37 aa, Artificial Sequence
  Description of Artificial Sequence: Synthetic polypeptide
DENCIATVNPVATECFGVVVCIDHQDQENRQGDNEMD

SEQ ID NO: 205179 - protein, 39 aa, Artificial Sequence
  Description of Artificial Sequence: Synthetic polypeptide
DEAEIGTTNPVATEQYGQCVCSNWGEDHNAENFSSDTQA

SEQ ID NO: 205180 - protein, 39 aa, Artificial Sequence
  Description of Artificial Sequence: Synthetic polypeptide
DEEAISTTNPVAYEQYGQCVCGNWMEDHNAEGFNSDNQF

SEQ ID NO: 205181 - protein, 39 aa, Artificial Sequence
  Description of Artificial Sequence: Synthetic polypeptide
AEAEISTTNPVATEQYGQCVCSNWGEDHNAEYFNSDNQS

SEQ ID NO: 205182 - protein, 39 aa, Artificial Sequence
  Description of Artificial Sequence: Synthetic polypeptide
AEAEISTTNPVATEQYGQCVCSNWGEDHNAENFNSDTQS

SEQ ID NO: 205183 - protein, 37 aa, Artificial Sequence
  Description of Artificial Sequence: Synthetic polypeptide
DENAEIATVNPVAYEQWGCVCGNGNEGEQDGQGQESQ

SEQ ID NO: 205184 - protein, 39 aa, Artificial Sequence
  Description of Artificial Sequence: Synthetic polypeptide
DEMEICTTNPVATEQYGCACGCHATDGPTVEPFEGNYDI

SEQ ID NO: 205185 - protein, 39 aa, Artificial Sequence
  Description of Artificial Sequence: Synthetic polypeptide
CEECISTTNPVATEQYGQCVCSNWGEDDNAEFFNSDTQS

SEQ ID NO: 205186 - protein, 35 aa, Artificial Sequence
  Description of Artificial Sequence: Synthetic polypeptide
DEHEIACTNPIATECWGATYYANENDQHEKTGKGM

SEQ ID NO: 205187 - protein, 38 aa, Artificial Sequence
  Description of Artificial Sequence: Synthetic polypeptide
DEEEIATTNPVATEQWGGCICAAQGNPDNTAAPGEGMH

SEQ ID NO: 205188 - protein, 39 aa, Artificial Sequence
  Description of Artificial Sequence: Synthetic polypeptide
CDEEISTTNPVATEQYGICVCSMSGEDHNAENFNSDTQA

SEQ ID NO: 205189 - protein, 38 aa, Artificial Sequence
  Description of Artificial Sequence: Synthetic polypeptide
DTTAEIATTNPVAYEQWGTASAGTGPAGNQHGDENGMN

SEQ ID NO: 205190 - protein, 36 aa, Artificial Sequence
  Description of Artificial Sequence: Synthetic polypeptide
SEAEIATTNPVAYEAWGVVWPGPNNENDGEQHNGSE

SEQ ID NO: 205191 - protein, 37 aa, Artificial Sequence
  Description of Artificial Sequence: Synthetic polypeptide
EEAAIATTNPVATEAYGSVCSESCIFGHSGGHSIFDG

SEQ ID NO: 205192 - protein, 37 aa, Artificial Sequence
  Description of Artificial Sequence: Synthetic polypeptide
EEAAIATTNPVATEAYGSVCSVSCIAGHSGGHSIFDE

SEQ ID NO: 205193 - protein, 35 aa, Artificial Sequence
  Description of Artificial Sequence: Synthetic polypeptide
SEAEIASTNPVGYEAYGQVVMPAYSPGLSAHVGAI

SEQ ID NO: 205194 - protein, 35 aa, Artificial Sequence
  Description of Artificial Sequence: Synthetic polypeptide
EEEEIASTNPVAYEAWGTCYCGEGNEDQDENPNTS

SEQ ID NO: 205195 - protein, 38 aa, Artificial Sequence
  Description of Artificial Sequence: Synthetic polypeptide
CEEEIACTNPVATEQWGGCCFATNGQNPETLENGEEWY

SEQ ID NO: 205196 - protein, 37 aa, Artificial Sequence
  Description of Artificial Sequence: Synthetic polypeptide
CDECISTTNPVAYEQYGCVCSNWGEHNAENFNSDTQM

SEQ ID NO: 205197 - protein, 34 aa, Artificial Sequence
  Description of Artificial Sequence: Synthetic polypeptide
EESEIASTNPVGTEAWGVCAPTDRDQHQGQHQMD

SEQ ID NO: 205198 - protein, 35 aa, Artificial Sequence
  Description of Artificial Sequence: Synthetic polypeptide
DTTEIRTTNPIATECWGATTWANAEDWAEPKGPYI

SEQ ID NO: 205199 - protein, 39 aa, Artificial Sequence
  Description of Artificial Sequence: Synthetic polypeptide
DDEEISTTNPVATEGYGQCVCSNWGEDHNAENFNSDTQF

SEQ ID NO: 205200 - protein, 39 aa, Artificial Sequence
  Description of Artificial Sequence: Synthetic polypeptide
CEECISTTNPVATEQYGQCVCSNWGEDDNAEYFNSETQS

SEQ ID NO: 205201 - protein, 36 aa, Artificial Sequence
  Description of Artificial Sequence: Synthetic polypeptide
SEAEIASTNPVGYEAYGQVVMAYSPGLSQNHVGALI

SEQ ID NO: 205202 - protein, 38 aa, Artificial Sequence
  Description of Artificial Sequence: Synthetic polypeptide
DEECISCTNPVATEGYGQCVCSNWGEDNAENFISDNQS

SEQ ID NO: 205203 - protein, 36 aa, Artificial Sequence
  Description of Artificial Sequence: Synthetic polypeptide
SEAEIASTNPVGYEAYGQVVMAYSPGLSQHAVGAIH

SEQ ID NO: 205204 - protein, 38 aa, Artificial Sequence
  Description of Artificial Sequence: Synthetic polypeptide
AEAEISTTNPVATEQYGQCVCSNWGEHNAENFISETQS

SEQ ID NO: 205205 - protein, 39 aa, Artificial Sequence
  Description of Artificial Sequence: Synthetic polypeptide
AEAEISTTNPVATEGYGQCVTSTWGADHNAENFGSDPQA

SEQ ID NO: 205206 - protein, 36 aa, Artificial Sequence
  Description of Artificial Sequence: Synthetic polypeptide
DEAEIKTTNPIATECWGATTWANAEDWQAEPKGPYY

SEQ ID NO: 205207 - protein, 39 aa, Artificial Sequence
  Description of Artificial Sequence: Synthetic polypeptide
DDEEISTTNPVATEGYGQCVCSNWGEDHNAENFNSDTQA

SEQ ID NO: 205208 - protein, 39 aa, Artificial Sequence
  Description of Artificial Sequence: Synthetic polypeptide
CEECISTTNPVATEQYGQCVCSNWGEDDNTEHFNSDNQA

SEQ ID NO: 205209 - protein, 38 aa, Artificial Sequence
  Description of Artificial Sequence: Synthetic polypeptide
DENCIRTTNPVATEQWGQCVCSNSGEPNAENSSSDTAA

SEQ ID NO: 205210 - protein, 35 aa, Artificial Sequence
  Description of Artificial Sequence: Synthetic polypeptide
DDAEVASTNPVSTEGYGCVCGNSEINQESFGSQQA

SEQ ID NO: 205211 - protein, 35 aa, Artificial Sequence
  Description of Artificial Sequence: Synthetic polypeptide
DDSEVASTNPVSTEGYGCVCQNSEPNQENFGSQQS

SEQ ID NO: 205212 - protein, 36 aa, Artificial Sequence
  Description of Artificial Sequence: Synthetic polypeptide
AEMEIACTNPCSYEQYGCVCSNWGELNQSFGSETQS

SEQ ID NO: 205213 - protein, 39 aa, Artificial Sequence
  Description of Artificial Sequence: Synthetic polypeptide
DSEEIRTTNPVGTEQWGQCVCSNWGEDHNAENFNSDNQS

SEQ ID NO: 205214 - protein, 39 aa, Artificial Sequence
  Description of Artificial Sequence: Synthetic polypeptide
DDEEISTTNPVATEGYGQCQVCSNWGEHNAENFNSETQA

SEQ ID NO: 205215 - protein, 35 aa, Artificial Sequence
  Description of Artificial Sequence: Synthetic polypeptide
QENEIATTNPVAYAPWGNTVAGSGHDQNHQMNMKK

SEQ ID NO: 205216 - protein, 39 aa, Artificial Sequence
  Description of Artificial Sequence: Synthetic polypeptide
DEECISTTNPVATEGYGQCVCSNWEEDDNAENFNSETQS

SEQ ID NO: 205217 - protein, 39 aa, Artificial Sequence
  Description of Artificial Sequence: Synthetic polypeptide
CDEEIRTTNPVATEGYGQCVCSNWGEDHNQENFGSDFQA

SEQ ID NO: 205218 - protein, 37 aa, Artificial Sequence
  Description of Artificial Sequence: Synthetic polypeptide
VEDEIATTNPVATEQWGCVAGNNGDPTTAAMDTGDHH

SEQ ID NO: 205219 - protein, 36 aa, Artificial Sequence
  Description of Artificial Sequence: Synthetic polypeptide
DEENIATTNPVAYTYITGGVTDYQVDPGAHVESQQD

SEQ ID NO: 205220 - protein, 37 aa, Artificial Sequence
  Description of Artificial Sequence: Synthetic polypeptide
VEDEIATTNPVAYEQWGQCIAGTGEPTQATAGGQNGQ

SEQ ID NO: 205221 - protein, 39 aa, Artificial Sequence
  Description of Artificial Sequence: Synthetic polypeptide
DDEEISTTNPVATEGYGQCVCSNWGEDHNAENFGSETQN

SEQ ID NO: 205222 - protein, 36 aa, Artificial Sequence
  Description of Artificial Sequence: Synthetic polypeptide
DEQEIRTTNPIATECWGATTCANAEDVWAEPKGPYI

SEQ ID NO: 205223 - protein, 39 aa, Artificial Sequence
  Description of Artificial Sequence: Synthetic polypeptide
AEAEISTTNPVATEQYGQCVCSNWGEDDNAENFNSETQS

SEQ ID NO: 205224 - protein, 36 aa, Artificial Sequence
  Description of Artificial Sequence: Synthetic polypeptide
VEDEIATTNPVAYEQWGTNCAATAGELGPDSKGAEH

SEQ ID NO: 205225 - protein, 37 aa, Artificial Sequence
  Description of Artificial Sequence: Synthetic polypeptide
VEDEIACTNPVAYEPWGSTVCAANDGPQEHQDGNEMK

SEQ ID NO: 205226 - protein, 37 aa, Artificial Sequence
  Description of Artificial Sequence: Synthetic polypeptide
EAAEIATTNPVATEQYGCVAAGEGGHGPNESGEEEGH

SEQ ID NO: 205227 - protein, 38 aa, Artificial Sequence
  Description of Artificial Sequence: Synthetic polypeptide
ACEEEIATTNPVAYEPWGSVYCGDRDDHQQDRGGGQKD

SEQ ID NO: 205228 - protein, 39 aa, Artificial Sequence
  Description of Artificial Sequence: Synthetic polypeptide
DDAEISTTNPVAYEQYGQCVCSNWGELHNAEGFNSDNQP

SEQ ID NO: 205229 - protein, 37 aa, Artificial Sequence
  Description of Artificial Sequence: Synthetic polypeptide
NEEPIGTTNPVATEQYGHCCYTDWWGDGGEGLFDSQY

SEQ ID NO: 205230 - protein, 38 aa, Artificial Sequence
  Description of Artificial Sequence: Synthetic polypeptide
AEMCIATTNPVATEGYGCVCSNWGEDHNAEHFGSENQS

SEQ ID NO: 205231 - protein, 37 aa, Artificial Sequence
  Description of Artificial Sequence: Synthetic polypeptide
QEGEIAPTNPCSYEQYGCVTVSCLNMLSQGVGGTPPD

SEQ ID NO: 205232 - protein, 36 aa, Artificial Sequence
  Description of Artificial Sequence: Synthetic polypeptide
DDSEVASTNPVSYEGYGTTVACNVTEISQSRTGGQR

SEQ ID NO: 205233 - protein, 37 aa, Artificial Sequence
  Description of Artificial Sequence: Synthetic polypeptide
TGQEIATTNPVAYEQWGSCVQNGGNAGEDPRREGDVP

SEQ ID NO: 205234 - protein, 37 aa, Artificial Sequence
  Description of Artificial Sequence: Synthetic polypeptide
VEDEIATTNPVAYEPQWGCVAINPAIGTAHQMDNEQN

SEQ ID NO: 205235 - protein, 38 aa, Artificial Sequence
  Description of Artificial Sequence: Synthetic polypeptide
CDEEIRTTNPVAYEGYGCVCSNWGPDHNEENFNSDTQS

SEQ ID NO: 205236 - protein, 38 aa, Artificial Sequence
  Description of Artificial Sequence: Synthetic polypeptide
VEDEIATTNPVAYEPQWGCVAINPAGLGTAHQMDNEQM

SEQ ID NO: 205237 - protein, 39 aa, Artificial Sequence
  Description of Artificial Sequence: Synthetic polypeptide
CEEEISTTNPVAYCQYGQCVCSTWGEDHNAENFNSDTQA

SEQ ID NO: 205238 - protein, 39 aa, Artificial Sequence
  Description of Artificial Sequence: Synthetic polypeptide
DEMCISTTNPVATEQYGQCVCSNWGEDHNAENFNSDNQQ

SEQ ID NO: 205239 - protein, 38 aa, Artificial Sequence
  Description of Artificial Sequence: Synthetic polypeptide
ADEEISTTNPVAYEQYGQCVCSMWGEHNAENFNSDTQF

SEQ ID NO: 205240 - protein, 37 aa, Artificial Sequence
  Description of Artificial Sequence: Synthetic polypeptide
VEDEIATTNPVAYEPQWGCSAINGALGTAHQMDNEQN

SEQ ID NO: 205241 - protein, 36 aa, Artificial Sequence
  Description of Artificial Sequence: Synthetic polypeptide
VEDEIATTNPVAYEPQWGCNVAGSGLADTPADDVTM

SEQ ID NO: 205242 - protein, 39 aa, Artificial Sequence
  Description of Artificial Sequence: Synthetic polypeptide
DDECISTTNPVATEQYGQCVCSNWGEDHNAENFNSDTQS

SEQ ID NO: 205243 - protein, 39 aa, Artificial Sequence
  Description of Artificial Sequence: Synthetic polypeptide
DSEEIRTTNPVGTEAYGIVQVVSQFQGESSAMTGGENHE

SEQ ID NO: 205244 - protein, 39 aa, Artificial Sequence
  Description of Artificial Sequence: Synthetic polypeptide
AEAEISTTNPVATEQYGQCVCSNWGEDDNAENFNSDTQS

SEQ ID NO: 205245 - protein, 39 aa, Artificial Sequence
  Description of Artificial Sequence: Synthetic polypeptide
DDEEISTTNPVATEGYGQCVCSNWGEDDNAENFNSETQS

SEQ ID NO: 205246 - protein, 39 aa, Artificial Sequence
  Description of Artificial Sequence: Synthetic polypeptide
EQQEIRTTNPVATEQVYGLWCVCTEEVPLEINIMSNQMD

SEQ ID NO: 205247 - protein, 34 aa, Artificial Sequence
  Description of Artificial Sequence: Synthetic polypeptide
SEAEIASTNPCGYEAYGQVVMAYSPGLSGHVGAI

SEQ ID NO: 205248 - protein, 39 aa, Artificial Sequence
  Description of Artificial Sequence: Synthetic polypeptide
AEAEISTTNPVATEQYGQCVCSNWGEDHNAENFNSDTQQ

SEQ ID NO: 205249 - protein, 35 aa, Artificial Sequence
  Description of Artificial Sequence: Synthetic polypeptide
TMDEIASVNPVCYEPYGVTVNTIDNLSTAAGGNNV

SEQ ID NO: 205250 - protein, 36 aa, Artificial Sequence
  Description of Artificial Sequence: Synthetic polypeptide
VEDEIATTNPVAYEQWGTNCAATAGELPDSKGDEHL

SEQ ID NO: 205251 - protein, 35 aa, Artificial Sequence
  Description of Artificial Sequence: Synthetic polypeptide
DDSEVASTNPVSTEGYGCVCQNWMEIQENFGSQQM

SEQ ID NO: 205252 - protein, 39 aa, Artificial Sequence
  Description of Artificial Sequence: Synthetic polypeptide
VEDEIATTNPVAYEQWGHCNVAGTNGEPTQATAGGQNGQ

SEQ ID NO: 205253 - protein, 35 aa, Artificial Sequence
  Description of Artificial Sequence: Synthetic polypeptide
DDSEVASTNPVSTEGYGCVCQTWEDQENFGSQTQS

SEQ ID NO: 205254 - protein, 36 aa, Artificial Sequence
  Description of Artificial Sequence: Synthetic polypeptide
DAHEIATTNPVAYAQWGCNTAGNNGLTTAEGGNLDS

SEQ ID NO: 205255 - protein, 39 aa, Artificial Sequence
  Description of Artificial Sequence: Synthetic polypeptide
DDEEISTTNPVATEGYGQCVCSMWGEDHNAEYFNSDTQS

SEQ ID NO: 205256 - protein, 38 aa, Artificial Sequence
  Description of Artificial Sequence: Synthetic polypeptide
DEECISTTNPVATEGYGQCVCSDWGEDNAENFSSDTQA

SEQ ID NO: 205257 - protein, 39 aa, Artificial Sequence
  Description of Artificial Sequence: Synthetic polypeptide
DDEEISTTNPVATEGYGQCVCSMWGEDHNAEYFNSETQA

SEQ ID NO: 205258 - protein, 38 aa, Artificial Sequence
  Description of Artificial Sequence: Synthetic polypeptide
DEECISCTNPVATEQYGCVCSNWGEDHNAENFMSDTQS

SEQ ID NO: 205259 - protein, 39 aa, Artificial Sequence
  Description of Artificial Sequence: Synthetic polypeptide
DEECISCTNPVATEQYGQCVCSNWGEDHNAEFFNSETQS

SEQ ID NO: 205260 - protein, 34 aa, Artificial Sequence
  Description of Artificial Sequence: Synthetic polypeptide
QENEIATTNPVAYAPWGNTTAGEGHLNQNHMNMK

SEQ ID NO: 205261 - protein, 36 aa, Artificial Sequence
  Description of Artificial Sequence: Synthetic polypeptide
DDSEVASTNPVSTEGYGCVCQTWEEIQERFGSQTQS

SEQ ID NO: 205262 - protein, 36 aa, Artificial Sequence
  Description of Artificial Sequence: Synthetic polypeptide
VEDEIATTNPVAYEQWWTCACAANAGELPDSGENGH

SEQ ID NO: 205263 - protein, 39 aa, Artificial Sequence
  Description of Artificial Sequence: Synthetic polypeptide
DDEEISTTNPVATEGYGQCVCSNSGEDHNAENFGSDTQD

SEQ ID NO: 205264 - protein, 36 aa, Artificial Sequence
  Description of Artificial Sequence: Synthetic polypeptide
EEPEIATTNPVAYEQWGVVCYQVEGNEKNQPDDTDG

SEQ ID NO: 205265 - protein, 39 aa, Artificial Sequence
  Description of Artificial Sequence: Synthetic polypeptide
DEECISCTNPVATEQYGQCVCSNWGEDHNAEGFNSDTQS

SEQ ID NO: 205266 - protein, 39 aa, Artificial Sequence
  Description of Artificial Sequence: Synthetic polypeptide
AEAEISTTNPVATEQYGQCVCSNWGEDHNAENFISDNQA

SEQ ID NO: 205267 - protein, 38 aa, Artificial Sequence
  Description of Artificial Sequence: Synthetic polypeptide
DEMCISTTNPVAYEQYGCVCSNWGEDPNAEHFNSDTQA

SEQ ID NO: 205268 - protein, 39 aa, Artificial Sequence
  Description of Artificial Sequence: Synthetic polypeptide
DEEVIACTNPVAYEQWGCSVIAETGNHGDNSAEMIGQNM

SEQ ID NO: 205269 - protein, 37 aa, Artificial Sequence
  Description of Artificial Sequence: Synthetic polypeptide
VEDEIATTNPVAYEPQWGTTACAANAGELPDSGENGH

SEQ ID NO: 205270 - protein, 39 aa, Artificial Sequence
  Description of Artificial Sequence: Synthetic polypeptide
AEAEISTTNPVATEQYGQCVCSNWGEDDNQENFNSDTQS

SEQ ID NO: 205271 - protein, 39 aa, Artificial Sequence
  Description of Artificial Sequence: Synthetic polypeptide
DDECISTTNPVATEQYGQCVCSNWGEDHNAENFNSDTQA

SEQ ID NO: 205272 - protein, 37 aa, Artificial Sequence
  Description of Artificial Sequence: Synthetic polypeptide
QEPEIATTNCVATEQYGVVAGPGEGEGGQGGGEEDIK

SEQ ID NO: 205273 - protein, 38 aa, Artificial Sequence
  Description of Artificial Sequence: Synthetic polypeptide
AEAEISTTNPVATEGYGQCVCSNWGEHNAENFNSDTQS

SEQ ID NO: 205274 - protein, 36 aa, Artificial Sequence
  Description of Artificial Sequence: Synthetic polypeptide
VEDEIATTNPVAYEQWGNPIATMTGGPMNADPGSKM

SEQ ID NO: 205275 - protein, 38 aa, Artificial Sequence
  Description of Artificial Sequence: Synthetic polypeptide
VEDEIATTNPVAYEQWGTTFACAATAGELPDSAGENGR

SEQ ID NO: 205276 - protein, 39 aa, Artificial Sequence
  Description of Artificial Sequence: Synthetic polypeptide
DDEEISTTNPVATEGYGQCVCSNWGEDDNAENFNSDFQS

SEQ ID NO: 205277 - protein, 39 aa, Artificial Sequence
  Description of Artificial Sequence: Synthetic polypeptide
DDEEISTTNPVATEGYGQCVCSNWGEDDNAENFNSDNQS

SEQ ID NO: 205278 - protein, 38 aa, Artificial Sequence
  Description of Artificial Sequence: Synthetic polypeptide
AEEEISTTNPVAYECYGTVQACTGYEGQQNKTFGGQHE

SEQ ID NO: 205279 - protein, 39 aa, Artificial Sequence
  Description of Artificial Sequence: Synthetic polypeptide
AEAEISTTNPVATEQYGQCVCSNWGEDHNAENFNSDTQA

SEQ ID NO: 205280 - protein, 38 aa, Artificial Sequence
  Description of Artificial Sequence: Synthetic polypeptide
AEECISTTNPVATEGYGQCVCSNWGEHNAENFNSDTQP

SEQ ID NO: 205281 - protein, 39 aa, Artificial Sequence
  Description of Artificial Sequence: Synthetic polypeptide
AEMEISTTNPVAYEQYGQCVCSTWGEDHNAENFNSETQQ

SEQ ID NO: 205282 - protein, 38 aa, Artificial Sequence
  Description of Artificial Sequence: Synthetic polypeptide
AEECISTTNPCATEQYGQCVCSNWGEHNAENFNSDTQS

SEQ ID NO: 205283 - protein, 39 aa, Artificial Sequence
  Description of Artificial Sequence: Synthetic polypeptide
AEMEISTTNPVATEQYGQCVCSNWGEDHNAENFNSDTQA

SEQ ID NO: 205284 - protein, 35 aa, Artificial Sequence
  Description of Artificial Sequence: Synthetic polypeptide
CAEEIATTNPVAYEPWGHSACAAANGDAMQGDQHQ

SEQ ID NO: 205285 - protein, 38 aa, Artificial Sequence
  Description of Artificial Sequence: Synthetic polypeptide
QEGEIAPTNPCSYEQYGVTVSCCPNMLSQNSNGGTDRP

SEQ ID NO: 205286 - protein, 37 aa, Artificial Sequence
  Description of Artificial Sequence: Synthetic polypeptide
CEDEIACTNPVATEQWGCVTAAGAHGENPPDQTEGRN

SEQ ID NO: 205287 - protein, 38 aa, Artificial Sequence
  Description of Artificial Sequence: Synthetic polypeptide
DDEEISTTNPVATCQYGCVCSNWGEDPNAENFISETQS

SEQ ID NO: 205288 - protein, 39 aa, Artificial Sequence
  Description of Artificial Sequence: Synthetic polypeptide
DERCISTTNPVATEQYGQCVCSNWEEDHNAENFISDNQS

SEQ ID NO: 205289 - protein, 38 aa, Artificial Sequence
  Description of Artificial Sequence: Synthetic polypeptide
AEEEISTTNPVAYEQYGQCVCFNWGEHNAENFNSETQS

SEQ ID NO: 205290 - protein, 39 aa, Artificial Sequence
  Description of Artificial Sequence: Synthetic polypeptide
DEMEISTTNPVAYEQYGQCVCSNWGEDDNAEFFGSDTQA

SEQ ID NO: 205291 - protein, 38 aa, Artificial Sequence
  Description of Artificial Sequence: Synthetic polypeptide
DEAEISTTNPVCTEHYGCVCSNWGEDHNAENFGSDTQS

SEQ ID NO: 205292 - protein, 36 aa, Artificial Sequence
  Description of Artificial Sequence: Synthetic polypeptide
NERCISTTNPVATEQYGCVCGWGEHNAENFISDTQS

SEQ ID NO: 205293 - protein, 39 aa, Artificial Sequence
  Description of Artificial Sequence: Synthetic polypeptide
DEAEISTTNPVAYEQYGQCVCSNSGEDHNAENFNSDTQS

SEQ ID NO: 205294 - protein, 37 aa, Artificial Sequence
  Description of Artificial Sequence: Synthetic polypeptide
CEEEIACTNPVAYEQYGSCAAAGGNHGNAEGGDGDKN

SEQ ID NO: 205295 - protein, 37 aa, Artificial Sequence
  Description of Artificial Sequence: Synthetic polypeptide
CEDEIACTNPVATEQWGGCCFATNQQNPETLENGEEA

SEQ ID NO: 205296 - protein, 38 aa, Artificial Sequence
  Description of Artificial Sequence: Synthetic polypeptide
QEQEIVTTNPAATEQYGQVVVGGNNDGEQEEGEGGDIQ

SEQ ID NO: 205297 - protein, 39 aa, Artificial Sequence
  Description of Artificial Sequence: Synthetic polypeptide
DENEIRTTNPVATEQWGICVCSNSGEDPNAENSSSDTAA

SEQ ID NO: 205298 - protein, 38 aa, Artificial Sequence
  Description of Artificial Sequence: Synthetic polypeptide
SEEEIACTNPVATEQYGQCSCPNWGADNAEHFISETQS

SEQ ID NO: 205299 - protein, 38 aa, Artificial Sequence
  Description of Artificial Sequence: Synthetic polypeptide
AENEIACTNPVATEGYGCSCSNWGEDDNAEYFGSDNQA

SEQ ID NO: 205300 - protein, 38 aa, Artificial Sequence
  Description of Artificial Sequence: Synthetic polypeptide
AEEEISTTNPVAYEQYGCVCSNWGEDHNEENFISDTQA

SEQ ID NO: 205301 - protein, 39 aa, Artificial Sequence
  Description of Artificial Sequence: Synthetic polypeptide
QENEIRTTNPVATEQWGAVVDNGEEGEENMNAGEGIGIQ

SEQ ID NO: 205302 - protein, 39 aa, Artificial Sequence
  Description of Artificial Sequence: Synthetic polypeptide
DEMEISTTNPVAYEQYGQCVCSNWEEDHNQENFNSDTQA

SEQ ID NO: 205303 - protein, 37 aa, Artificial Sequence
  Description of Artificial Sequence: Synthetic polypeptide
CEEEIACTNPVAYEQYGSCAAAGGNHGNAEGGDGQEH

SEQ ID NO: 205304 - protein, 39 aa, Artificial Sequence
  Description of Artificial Sequence: Synthetic polypeptide
AEMEISTTNPVATEQYGQCVCSNSGEDHNAENFNSDTQS

SEQ ID NO: 205305 - protein, 39 aa, Artificial Sequence
  Description of Artificial Sequence: Synthetic polypeptide
AEEEISTTNPVAYEQYGQCAVCSNWGEDNAEFFNSDNQS

SEQ ID NO: 205306 - protein, 39 aa, Artificial Sequence
  Description of Artificial Sequence: Synthetic polypeptide
CEAEISTTNPVATEQYGQCQVCSSGEDHNAENFNSDTQS

SEQ ID NO: 205307 - protein, 37 aa, Artificial Sequence
  Description of Artificial Sequence: Synthetic polypeptide
CESEIATTNPCASEGWGTVCSATGEEWSENMNVGNDP

SEQ ID NO: 205308 - protein, 39 aa, Artificial Sequence
  Description of Artificial Sequence: Synthetic polypeptide
AEMEISTTNPVATEQYGQCVCSNWGEDHNAENFNSDNQS

SEQ ID NO: 205309 - protein, 38 aa, Artificial Sequence
  Description of Artificial Sequence: Synthetic polypeptide
DDEAISTTNPVATEGYGQCVCSNWGEHNAENFNSDTQF

SEQ ID NO: 205310 - protein, 36 aa, Artificial Sequence
  Description of Artificial Sequence: Synthetic polypeptide
AENEIACTNPVATEGYGCSCSNWGEDNQYFISDTQS

SEQ ID NO: 205311 - protein, 38 aa, Artificial Sequence
  Description of Artificial Sequence: Synthetic polypeptide
DDECISTTNPVAYEQYGCVCSNWGEDHNAEGFNSETQG

SEQ ID NO: 205312 - protein, 39 aa, Artificial Sequence
  Description of Artificial Sequence: Synthetic polypeptide
AEEEISTTNPVAYEQYGQCQVCSNWGEDNAENFNSETQS

SEQ ID NO: 205313 - protein, 37 aa, Artificial Sequence
  Description of Artificial Sequence: Synthetic polypeptide
AENEIACTNPVATEGYGCSCSNWGEDNAEYFNSDTQS

SEQ ID NO: 205314 - protein, 38 aa, Artificial Sequence
  Description of Artificial Sequence: Synthetic polypeptide
DEAEISTTNPVAYEQYGCICSNWGEDHNAENFPSDNQA

SEQ ID NO: 205315 - protein, 37 aa, Artificial Sequence
  Description of Artificial Sequence: Synthetic polypeptide
SEAEISCTNPVATEQYGCVCEWGEDDNQEHFGSDTQA

SEQ ID NO: 205316 - protein, 39 aa, Artificial Sequence
  Description of Artificial Sequence: Synthetic polypeptide
AEEEISTTNPVAYEQYGQCVCQNWGEDHNTENFFSDNQQ

SEQ ID NO: 205317 - protein, 38 aa, Artificial Sequence
  Description of Artificial Sequence: Synthetic polypeptide
AEEEISTTNPVAYEQYGQCVCQNWGEHNAENFNSQTQP

SEQ ID NO: 205318 - protein, 37 aa, Artificial Sequence
  Description of Artificial Sequence: Synthetic polypeptide
DEAEISTTNPVAYEQWGCVCSNSGEENAEYSISDTAS

SEQ ID NO: 205319 - protein, 39 aa, Artificial Sequence
  Description of Artificial Sequence: Synthetic polypeptide
AEMEISTTNPVATEQYGQCVCSNWGEDHNAENFNSENQS

SEQ ID NO: 205320 - protein, 39 aa, Artificial Sequence
  Description of Artificial Sequence: Synthetic polypeptide
AEEEISTTNPVAYEQYGQCVCSNWEEDHNAEYFNSDNQA

SEQ ID NO: 205321 - protein, 37 aa, Artificial Sequence
  Description of Artificial Sequence: Synthetic polypeptide
DTEAEIRCTNPVSYEPWGKISCSEDSISDQSNGGNTS

SEQ ID NO: 205322 - protein, 36 aa, Artificial Sequence
  Description of Artificial Sequence: Synthetic polypeptide
DTEAEIRCTNPVSYEPWGKISCWEDEISIQSNGGNT

SEQ ID NO: 205323 - protein, 37 aa, Artificial Sequence
  Description of Artificial Sequence: Synthetic polypeptide
DTEAEIRCTNPVSYEPWGKISCWEGSISDQSEGGNTY

SEQ ID NO: 205324 - protein, 39 aa, Artificial Sequence
  Description of Artificial Sequence: Synthetic polypeptide
DEEEIRCTNPVAYEQYGQCVCSMWGEDDNAEGFISDTQA

SEQ ID NO: 205325 - protein, 40 aa, Artificial Sequence
  Description of Artificial Sequence: Synthetic polypeptide
DTEAHQEIATTNPVAYEQWGSVGMNNNALPPAQMNGDLAN

SEQ ID NO: 205326 - protein, 38 aa, Artificial Sequence
  Description of Artificial Sequence: Synthetic polypeptide
DDECISTTNPVAYEQYGCVCSNWEEDHNIENFNSDPQA

SEQ ID NO: 205327 - protein, 39 aa, Artificial Sequence
  Description of Artificial Sequence: Synthetic polypeptide
AEMEISTTNPVATEQYGQCVCSNWGEDHNAENFNSETQS

SEQ ID NO: 205328 - protein, 38 aa, Artificial Sequence
  Description of Artificial Sequence: Synthetic polypeptide
DDEEISTTNPVATCGYGCVCSNWGEDPNAENFGSDTQA

SEQ ID NO: 205329 - protein, 39 aa, Artificial Sequence
  Description of Artificial Sequence: Synthetic polypeptide
DEAEISTTNPVATEQYGQCVCSNWGEDHNEENFISDTQS

SEQ ID NO: 205330 - protein, 38 aa, Artificial Sequence
  Description of Artificial Sequence: Synthetic polypeptide
DEESIACTNPVATAQWGNICSEANPATPNDHGGGMNHH

SEQ ID NO: 205331 - protein, 39 aa, Artificial Sequence
  Description of Artificial Sequence: Synthetic polypeptide
AEMEISTTNPVATEQYGQCVCSNWGEDHNAENSNSENQS

SEQ ID NO: 205332 - protein, 39 aa, Artificial Sequence
  Description of Artificial Sequence: Synthetic polypeptide
AEEEISTTNPVAYEQYGQCVCSNWEEDHNAEYFNSDNQG

SEQ ID NO: 205333 - protein, 39 aa, Artificial Sequence
  Description of Artificial Sequence: Synthetic polypeptide
DEEEIRATNPVATEIYGQMGYMDGSGNMDDIMDEGGTGT

SEQ ID NO: 205334 - protein, 37 aa, Artificial Sequence
  Description of Artificial Sequence: Synthetic polypeptide
DEAEISTTNPVAYESWGVAACMDNGNDQRGQGGTIMS

SEQ ID NO: 205335 - protein, 39 aa, Artificial Sequence
  Description of Artificial Sequence: Synthetic polypeptide
AEMEISTTNPVATEQYGQCVCSNWGEDHNAENFNSDTQS

SEQ ID NO: 205336 - protein, 38 aa, Artificial Sequence
  Description of Artificial Sequence: Synthetic polypeptide
CEDEIACTNPVATEQWGCVNAGAGAHTENPPDQTEGRN

SEQ ID NO: 205337 - protein, 38 aa, Artificial Sequence
  Description of Artificial Sequence: Synthetic polypeptide
AEEEISTTNPVAYEQYGQCVCSDWGEDNAENFSSDTQA

SEQ ID NO: 205338 - protein, 39 aa, Artificial Sequence
  Description of Artificial Sequence: Synthetic polypeptide
AEEEISTTNPVAYEQYGQCVCSMWGEDHNAEHFNSDTQL

SEQ ID NO: 205339 - protein, 39 aa, Artificial Sequence
  Description of Artificial Sequence: Synthetic polypeptide
AEEEISTTNPVAYEQYGQCVCSNSGEDDNAENFNSETQA

SEQ ID NO: 205340 - protein, 38 aa, Artificial Sequence
  Description of Artificial Sequence: Synthetic polypeptide
SEAEISCTNPVATEQYGCVCENWGELHNAEHFNSDTQS

SEQ ID NO: 205341 - protein, 38 aa, Artificial Sequence
  Description of Artificial Sequence: Synthetic polypeptide
DDEEIRTTNPVGTEQWGQCVCSNWGEHNAENFISDTQS

SEQ ID NO: 205342 - protein, 39 aa, Artificial Sequence
  Description of Artificial Sequence: Synthetic polypeptide
DEEEIGTTNPVAYEQYGQCVCGNWGEDHNAENFNSDNQA

SEQ ID NO: 205343 - protein, 39 aa, Artificial Sequence
  Description of Artificial Sequence: Synthetic polypeptide
AEMEISTTNPVATEQYGQCVCSNWGEDHNAENFNSDTQP

SEQ ID NO: 205344 - protein, 36 aa, Artificial Sequence
  Description of Artificial Sequence: Synthetic polypeptide
DTEACIRCTNPVSYEPWGKISCWEDSISDQGNGGNT

SEQ ID NO: 205345 - protein, 37 aa, Artificial Sequence
  Description of Artificial Sequence: Synthetic polypeptide
DDECISTTNPVATEGYGQCVCSWGEHNAENFISDTQA

SEQ ID NO: 205346 - protein, 39 aa, Artificial Sequence
  Description of Artificial Sequence: Synthetic polypeptide
AEEEISTTNPVAYEQYGQCVCSNSGEDHNAEYFNSDTQS

SEQ ID NO: 205347 - protein, 38 aa, Artificial Sequence
  Description of Artificial Sequence: Synthetic polypeptide
DDECISTTNPVATEGYGQCVCSNWGEHNAENFNSDTQA

SEQ ID NO: 205348 - protein, 39 aa, Artificial Sequence
  Description of Artificial Sequence: Synthetic polypeptide
SEAEIRTTNPVATEQYGQCVCGNWGADHNAENFGSDTQA

SEQ ID NO: 205349 - protein, 37 aa, Artificial Sequence
  Description of Artificial Sequence: Synthetic polypeptide
AEAEIATTNPVAYERWGSVACQQPNEEQGEQMGMDKK

SEQ ID NO: 205350 - protein, 37 aa, Artificial Sequence
  Description of Artificial Sequence: Synthetic polypeptide
VEDEIACTNPVATAQWGHSPSATWPAGTNQGNGMEGV

SEQ ID NO: 205351 - protein, 39 aa, Artificial Sequence
  Description of Artificial Sequence: Synthetic polypeptide
DEAEISTTNPVAYEQYGQCVCSNWGEDHNAENFQSDTQS

SEQ ID NO: 205352 - protein, 38 aa, Artificial Sequence
  Description of Artificial Sequence: Synthetic polypeptide
DDEAISTTNPVATEGYGCVCSNWGEDHNAENFNSDTQS

SEQ ID NO: 205353 - protein, 39 aa, Artificial Sequence
  Description of Artificial Sequence: Synthetic polypeptide
DEMEISTTNPVAYEQYGQCVCSNWEEDHNAENFNSDTQS

SEQ ID NO: 205354 - protein, 39 aa, Artificial Sequence
  Description of Artificial Sequence: Synthetic polypeptide
SEAEISTTNPVATEQYGQCVCSNWGEDHNAENFNSDTQA

SEQ ID NO: 205355 - protein, 34 aa, Artificial Sequence
  Description of Artificial Sequence: Synthetic polypeptide
DDSEVASTNPVSTEGWGNTVWAAADIAERKGQYR

SEQ ID NO: 205356 - protein, 39 aa, Artificial Sequence
  Description of Artificial Sequence: Synthetic polypeptide
DEMEISTTNPVAYEQYGQCVCSNSGEDHNQEYFGSETQA

SEQ ID NO: 205357 - protein, 35 aa, Artificial Sequence
  Description of Artificial Sequence: Synthetic polypeptide
DSSEVASTNPVSYEPYGEVVAANTISQSSVGGQNG

SEQ ID NO: 205358 - protein, 36 aa, Artificial Sequence
  Description of Artificial Sequence: Synthetic polypeptide
DSSEVASTNPVSYEPYGEVVAAANTASQIHPGGQNR

SEQ ID NO: 205359 - protein, 33 aa, Artificial Sequence
  Description of Artificial Sequence: Synthetic polypeptide
DDSEVASTNPVSTEGWGNTTWANNTIASPVGPR

SEQ ID NO: 205360 - protein, 40 aa, Artificial Sequence
  Description of Artificial Sequence: Synthetic polypeptide
DEEEIRTTNPVAYEQYGQCQVCGNWGEDHNAENFNSETQS

SEQ ID NO: 205361 - protein, 35 aa, Artificial Sequence
  Description of Artificial Sequence: Synthetic polypeptide
DSSEVASTNPVSYEPYGCNTVACNTISGSRVGGQR

SEQ ID NO: 205362 - protein, 34 aa, Artificial Sequence
  Description of Artificial Sequence: Synthetic polypeptide
QENEIATTNPVAYEPWGPNVAGEGPGNHMEMQLN

SEQ ID NO: 205363 - protein, 39 aa, Artificial Sequence
  Description of Artificial Sequence: Synthetic polypeptide
DEAEISTTNPVAYEQYGQCVCSNWGEDDNAENFNSDFQS

SEQ ID NO: 205364 - protein, 38 aa, Artificial Sequence
  Description of Artificial Sequence: Synthetic polypeptide
DEAEIRTTNPVAYEGYGQCICSNWGEHNAENFPSDNQA

SEQ ID NO: 205365 - protein, 36 aa, Artificial Sequence
  Description of Artificial Sequence: Synthetic polypeptide
QENEIATTNPVAYEPWGPNVAGENGLQQNHMEMQLN

SEQ ID NO: 205366 - protein, 36 aa, Artificial Sequence
  Description of Artificial Sequence: Synthetic polypeptide
DEGQIGTTNPVATEQYGCLCTATDTSPVEFETSDKQ

SEQ ID NO: 205367 - protein, 34 aa, Artificial Sequence
  Description of Artificial Sequence: Synthetic polypeptide
DDSEVASTNPVSTEGWGNTTWANADIAERKGQYR

SEQ ID NO: 205368 - protein, 38 aa, Artificial Sequence
  Description of Artificial Sequence: Synthetic polypeptide
DDECISTTNPVATCQYGCVCSMWGEDPNAENFGSDTQA

SEQ ID NO: 205369 - protein, 39 aa, Artificial Sequence
  Description of Artificial Sequence: Synthetic polypeptide
DDEEISTTNPVATEQYGQCVCSMWGEDHNQEHFISDTQA

SEQ ID NO: 205370 - protein, 37 aa, Artificial Sequence
  Description of Artificial Sequence: Synthetic polypeptide
VEDEIACTNPVATEQWGCVAAIANADTAAATGDDNTA

SEQ ID NO: 205371 - protein, 39 aa, Artificial Sequence
  Description of Artificial Sequence: Synthetic polypeptide
DDEEISTTNPVATEQYGQCVCSNWGEDDNAENFISETQA

SEQ ID NO: 205372 - protein, 39 aa, Artificial Sequence
  Description of Artificial Sequence: Synthetic polypeptide
SEAEISTTNPVATEQYGQCVCSNWGEDHNAENFPSDNQS

SEQ ID NO: 205373 - protein, 37 aa, Artificial Sequence
  Description of Artificial Sequence: Synthetic polypeptide
VEDEIACTNPVATEQWGCVAAIANATTAAALGDDNEM

SEQ ID NO: 205374 - protein, 39 aa, Artificial Sequence
  Description of Artificial Sequence: Synthetic polypeptide
NEREIRTTNPVATEQYGQCVCGNWGEDHNAEHFGSDTQS

SEQ ID NO: 205375 - protein, 38 aa, Artificial Sequence
  Description of Artificial Sequence: Synthetic polypeptide
SEEEIACTNPVATEQWGHSVAACPGNSHPSAEDQGEEG

SEQ ID NO: 205376 - protein, 38 aa, Artificial Sequence
  Description of Artificial Sequence: Synthetic polypeptide
AEAEISTTNPVAYEQYGQCVCSNWGEDNAENFNSETQS

SEQ ID NO: 205377 - protein, 39 aa, Artificial Sequence
  Description of Artificial Sequence: Synthetic polypeptide
SEAEISTTNPVATEQYGQCVCSNWGEDHNAEHFNSENQS

SEQ ID NO: 205378 - protein, 36 aa, Artificial Sequence
  Description of Artificial Sequence: Synthetic polypeptide
DSSEVASTNPVSYEGYGNVVCACNTISQAQVGGQNR

SEQ ID NO: 205379 - protein, 39 aa, Artificial Sequence
  Description of Artificial Sequence: Synthetic polypeptide
SEEEIACTNPVATEQWGHVVAANGGAGGENTPDVEDSRM

SEQ ID NO: 205380 - protein, 39 aa, Artificial Sequence
  Description of Artificial Sequence: Synthetic polypeptide
SEAEISTTNPVATEQYGQCVCSNWGEDHNAENFNSDTQS

SEQ ID NO: 205381 - protein, 37 aa, Artificial Sequence
  Description of Artificial Sequence: Synthetic polypeptide
VEDEIACTNPVATEQWGCVAAIANALTAAATGDDMEM

SEQ ID NO: 205382 - protein, 38 aa, Artificial Sequence
  Description of Artificial Sequence: Synthetic polypeptide
QENEIATTNPVAYEPYGFNTVSGEEHLNQNHGMEMQLN

SEQ ID NO: 205383 - protein, 37 aa, Artificial Sequence
  Description of Artificial Sequence: Synthetic polypeptide
NENEEIATTNPVAYEAWGVVWPGPNNENDSGIQNGEE

SEQ ID NO: 205384 - protein, 36 aa, Artificial Sequence
  Description of Artificial Sequence: Synthetic polypeptide
DSSEVASTNPVSYEGYGQVVACNTISQSLVGGQNRF

SEQ ID NO: 205385 - protein, 37 aa, Artificial Sequence
  Description of Artificial Sequence: Synthetic polypeptide
SEAEIRSTNPVAYEQYASLWTVKANSEEDEGQEEDII

SEQ ID NO: 205386 - protein, 39 aa, Artificial Sequence
  Description of Artificial Sequence: Synthetic polypeptide
DEAEIRTTNPVATEQYGYICVHYPIGPLKESFAEEESED

SEQ ID NO: 205387 - protein, 35 aa, Artificial Sequence
  Description of Artificial Sequence: Synthetic polypeptide
DEMAICSTNPVATEQYGCLCTATDGSPVEFETDKQ

SEQ ID NO: 205388 - protein, 34 aa, Artificial Sequence
  Description of Artificial Sequence: Synthetic polypeptide
DESEICTTNPCSTEPWGCIAPEDQQQQQQQGTHQ

SEQ ID NO: 205389 - protein, 38 aa, Artificial Sequence
  Description of Artificial Sequence: Synthetic polypeptide
DEESIACTNPVATEQWGHSVAACPGNSHPSAEDSGEEQ

SEQ ID NO: 205390 - protein, 36 aa, Artificial Sequence
  Description of Artificial Sequence: Synthetic polypeptide
DSSEVASTNPVSYEPYGNVVPAANTISQNHVGGQNR

SEQ ID NO: 205391 - protein, 39 aa, Artificial Sequence
  Description of Artificial Sequence: Synthetic polypeptide
DEAEISTTNPVAYEQYGQCVCSNWGEDHNAENFNSETQA

SEQ ID NO: 205392 - protein, 36 aa, Artificial Sequence
  Description of Artificial Sequence: Synthetic polypeptide
DSSEVSSTNPVSYEGYGINVVACNTISQSQVGGQNR

SEQ ID NO: 205393 - protein, 39 aa, Artificial Sequence
  Description of Artificial Sequence: Synthetic polypeptide
DESEIATTNPIVAYITPYRGSTVASTPHSPEKTVGNNNT

SEQ ID NO: 205394 - protein, 38 aa, Artificial Sequence
  Description of Artificial Sequence: Synthetic polypeptide
AEECISCTNPVATEQYGCQVCSNWGEDNAENFNSDTQS

SEQ ID NO: 205395 - protein, 38 aa, Artificial Sequence
  Description of Artificial Sequence: Synthetic polypeptide
CEEEIACTNPVATEQWGCNVAAITNGLEAPADITESFM

SEQ ID NO: 205396 - protein, 35 aa, Artificial Sequence
  Description of Artificial Sequence: Synthetic polypeptide
DSTEIRTTNPIATECWGATTWANAEDWAEPKGPPI

SEQ ID NO: 205397 - protein, 38 aa, Artificial Sequence
  Description of Artificial Sequence: Synthetic polypeptide
AEMEISTTNPVATEQYGQCVCQNWGAHNIENFISDTQS

SEQ ID NO: 205398 - protein, 37 aa, Artificial Sequence
  Description of Artificial Sequence: Synthetic polypeptide
CEDEIACTNPVATEQWGMCCFATGQNPETLENGEEAN

SEQ ID NO: 205399 - protein, 37 aa, Artificial Sequence
  Description of Artificial Sequence: Synthetic polypeptide
DSTVIQTTNPVAYEQWGCVAACTVNPSDVRPPGQEPK

SEQ ID NO: 205400 - protein, 38 aa, Artificial Sequence
  Description of Artificial Sequence: Synthetic polypeptide
DDECISTTNPVATEHYGQCVCSMWGEHNQEFFNSQNQS

SEQ ID NO: 205401 - protein, 39 aa, Artificial Sequence
  Description of Artificial Sequence: Synthetic polypeptide
DEMEISTTNPVAYEQYGQCVCSNWEEDHNAENFNSDTQL

SEQ ID NO: 205402 - protein, 38 aa, Artificial Sequence
  Description of Artificial Sequence: Synthetic polypeptide
DDEAISTTNPVATEGYGCVCSNWEEDHNAENFNSDFQS

SEQ ID NO: 205403 - protein, 35 aa, Artificial Sequence
  Description of Artificial Sequence: Synthetic polypeptide
DSTEIRTTNPIATECWGATTWANAEDWAEPKGPYI

SEQ ID NO: 205404 - protein, 36 aa, Artificial Sequence
  Description of Artificial Sequence: Synthetic polypeptide
SDECIATTNPVAYEGWGTVCHLNNDSNDQDHQNHPR

SEQ ID NO: 205405 - protein, 39 aa, Artificial Sequence
  Description of Artificial Sequence: Synthetic polypeptide
DEAEISTTNPVAYEQYGQCVCSNWGEDHNAENFNSDTQS

SEQ ID NO: 205406 - protein, 40 aa, Artificial Sequence
  Description of Artificial Sequence: Synthetic polypeptide
AEECIRTTNPVATEQYGQCQVCSNWGEDHNAENFNSETQS

SEQ ID NO: 205407 - protein, 37 aa, Artificial Sequence
  Description of Artificial Sequence: Synthetic polypeptide
QEGEIAPTNPCSYEQYGVTVSCCNMLSDNSNGGTDRI

SEQ ID NO: 205408 - protein, 39 aa, Artificial Sequence
  Description of Artificial Sequence: Synthetic polypeptide
SEAEISTTNPVATEQYGQCVCSNSGEDHNAEYFNSETQS

SEQ ID NO: 205409 - protein, 39 aa, Artificial Sequence
  Description of Artificial Sequence: Synthetic polypeptide
DEAEISTTNPVAYEQYGQCVCSNWGEDHNAENFNSDFQP

SEQ ID NO: 205410 - protein, 39 aa, Artificial Sequence
  Description of Artificial Sequence: Synthetic polypeptide
DEAEISTTNPVAYEQYGQCVCSNWGEDHNAENFNSDTQA

SEQ ID NO: 205411 - protein, 38 aa, Artificial Sequence
  Description of Artificial Sequence: Synthetic polypeptide
DEMAIATTNPVATEGYGCVCSTWGEDHNAEHFISETQA

SEQ ID NO: 205412 - protein, 39 aa, Artificial Sequence
  Description of Artificial Sequence: Synthetic polypeptide
DDEEISTTNPVATEQYGQCVCGNWGEDDNAEHFNSENQP

SEQ ID NO: 205413 - protein, 35 aa, Artificial Sequence
  Description of Artificial Sequence: Synthetic polypeptide
DSSEVASTNPVSYEPYGNVVAANTISGVSVGGQNR

SEQ ID NO: 205414 - protein, 36 aa, Artificial Sequence
  Description of Artificial Sequence: Synthetic polypeptide
DSSEVASTNPVSYEPYGNVVAANTEISQSSFGGQNR

SEQ ID NO: 205415 - protein, 40 aa, Artificial Sequence
  Description of Artificial Sequence: Synthetic polypeptide
DDEEISTTNPVATEQYGQCQVCSMWGEEHNAENFNSDTQA

SEQ ID NO: 205416 - protein, 40 aa, Artificial Sequence
  Description of Artificial Sequence: Synthetic polypeptide
DDEEISTTNPVATEQYGQCQVCGNSGEDDNTENFNSETQA

SEQ ID NO: 205417 - protein, 36 aa, Artificial Sequence
  Description of Artificial Sequence: Synthetic polypeptide
CAEEIATTNPVAYEQWGSTCAMNNGGEPDIGGGEMW

SEQ ID NO: 205418 - protein, 38 aa, Artificial Sequence
  Description of Artificial Sequence: Synthetic polypeptide
DEAEIRTTNPVAYEGWGQCVCSWGEDENAEYFGSDTQA

SEQ ID NO: 205419 - protein, 40 aa, Artificial Sequence
  Description of Artificial Sequence: Synthetic polypeptide
DDEEISTTNPVATEQYGQCIVCGNWGEDHNAEGFNSDTQS

SEQ ID NO: 205420 - protein, 38 aa, Artificial Sequence
  Description of Artificial Sequence: Synthetic polypeptide
DEEEIGTTNPVAYEGYGQCVCSNWGEDDNANFNSDTQS

SEQ ID NO: 205421 - protein, 38 aa, Artificial Sequence
  Description of Artificial Sequence: Synthetic polypeptide
AEEEISTTNPVAYEQYGCVCSNWGEDHNAENFISETQA

SEQ ID NO: 205422 - protein, 38 aa, Artificial Sequence
  Description of Artificial Sequence: Synthetic polypeptide
DDECISTTNPVAYEQYGCVCSNWEEDHNAENFNSDTQG

SEQ ID NO: 205423 - protein, 39 aa, Artificial Sequence
  Description of Artificial Sequence: Synthetic polypeptide
DEEEIACTNPVATEQYGSNCAAAAGEGVPLEAMEHGHHT

SEQ ID NO: 205424 - protein, 39 aa, Artificial Sequence
  Description of Artificial Sequence: Synthetic polypeptide
DEMEISTTNPVAYEQYGQCVCSNWGEDDNAENFNSENQG

SEQ ID NO: 205425 - protein, 38 aa, Artificial Sequence
  Description of Artificial Sequence: Synthetic polypeptide
DEMCISTTNPVATEGYGCVCSNWGEDDNAEFFGSDTQA

SEQ ID NO: 205426 - protein, 39 aa, Artificial Sequence
  Description of Artificial Sequence: Synthetic polypeptide
DEAEISTTNPVAYEQYGQCVCSNWGPDHNAENFNSDTQS

SEQ ID NO: 205427 - protein, 38 aa, Artificial Sequence
  Description of Artificial Sequence: Synthetic polypeptide
DDECISTTNPVATEGYGQCVCSNWGEDNAENFNSETQS

SEQ ID NO: 205428 - protein, 39 aa, Artificial Sequence
  Description of Artificial Sequence: Synthetic polypeptide
DEEEISCTNPVATEEYGQCVCSNSGEDHNAESFNSDTQS

SEQ ID NO: 205429 - protein, 38 aa, Artificial Sequence
  Description of Artificial Sequence: Synthetic polypeptide
SDEEIRTTNPVAYEQYGCVCSNWGEDHNAENFMSDTQS

SEQ ID NO: 205430 - protein, 38 aa, Artificial Sequence
  Description of Artificial Sequence: Synthetic polypeptide
VEEEIACTNPVATEQWGHVVANTGALADAGTHQISESW

SEQ ID NO: 205431 - protein, 36 aa, Artificial Sequence
  Description of Artificial Sequence: Synthetic polypeptide
DEMEIRTTNPIATECWGATTCSAAEGWVAEPKGPYI

SEQ ID NO: 205432 - protein, 37 aa, Artificial Sequence
  Description of Artificial Sequence: Synthetic polypeptide
AENCIACTNPVATEQYGCSCSWGEDDNAENFNSQTQS

SEQ ID NO: 205433 - protein, 36 aa, Artificial Sequence
  Description of Artificial Sequence: Synthetic polypeptide
AENCIACTNPVATEQYGCSCSWGEDNQENFISQTQS

SEQ ID NO: 205434 - protein, 40 aa, Artificial Sequence
  Description of Artificial Sequence: Synthetic polypeptide
CEAEIWTTNPVATEQYGDVVVGNGQTDQEEQDGEGEGNGV

SEQ ID NO: 205435 - protein, 37 aa, Artificial Sequence
  Description of Artificial Sequence: Synthetic polypeptide
AENCIACTNPVATEQYGCSCSWMEDHNAEYFNSDTQS

SEQ ID NO: 205436 - protein, 37 aa, Artificial Sequence
  Description of Artificial Sequence: Synthetic polypeptide
AENCIATTNPVATEGYGCVCSNWGEHNIEHFISENQA

SEQ ID NO: 205437 - protein, 38 aa, Artificial Sequence
  Description of Artificial Sequence: Synthetic polypeptide
DDEEISCTNPVATEQYGCVCGNWGEDHNAENFNSDNQM

SEQ ID NO: 205438 - protein, 38 aa, Artificial Sequence
  Description of Artificial Sequence: Synthetic polypeptide
DEEEISCTNPVATEGYGQCVCQNWGEHNAENFNSENQL

SEQ ID NO: 205439 - protein, 38 aa, Artificial Sequence
  Description of Artificial Sequence: Synthetic polypeptide
AEEEISTTNPVAYEQYGQCVCSWGEDHNAENFISEFQA

SEQ ID NO: 205440 - protein, 39 aa, Artificial Sequence
  Description of Artificial Sequence: Synthetic polypeptide
DEAEISTTNPVAYEGYGQCVCSNWGEDHNTENFGSENQA

SEQ ID NO: 205441 - protein, 39 aa, Artificial Sequence
  Description of Artificial Sequence: Synthetic polypeptide
DEEEISCTNPVATEGYGQCVCSMWGEDDNQEGFISDTQA

SEQ ID NO: 205442 - protein, 38 aa, Artificial Sequence
  Description of Artificial Sequence: Synthetic polypeptide
DEAEISTTNPVAYEGYGQCVCSNWGEHNAENFNSDNQS

SEQ ID NO: 205443 - protein, 38 aa, Artificial Sequence
  Description of Artificial Sequence: Synthetic polypeptide
DDECIRTTNPVATEQWGQCVTSNWGEHNAENFISDTAS

SEQ ID NO: 205444 - protein, 39 aa, Artificial Sequence
  Description of Artificial Sequence: Synthetic polypeptide
DEEEIACTNPVATEQYGVSCAAAAGEGVPLEAMEHGHHE

SEQ ID NO: 205445 - protein, 39 aa, Artificial Sequence
  Description of Artificial Sequence: Synthetic polypeptide
DEAEISTTNPVAYEQYGQCVCSNWGEDPNAENFNSDNQA

SEQ ID NO: 205446 - protein, 39 aa, Artificial Sequence
  Description of Artificial Sequence: Synthetic polypeptide
DEAEISTTNPVAYEQYGQCVCSNWMEDHNAEYFNSENQS

SEQ ID NO: 205447 - protein, 39 aa, Artificial Sequence
  Description of Artificial Sequence: Synthetic polypeptide
DEECIRCTNPVAYEQYGQCVCSNWGEDHNAENFNSETQS

SEQ ID NO: 205448 - protein, 37 aa, Artificial Sequence
  Description of Artificial Sequence: Synthetic polypeptide
CAEEIATTNPVATEQWGCVAGGATQPGAEAAIGDDGE

SEQ ID NO: 205449 - protein, 38 aa, Artificial Sequence
  Description of Artificial Sequence: Synthetic polypeptide
CEEEIATTNPVATEQWGGCCPAAQGNPDNTAAPGEGNH

SEQ ID NO: 205450 - protein, 36 aa, Artificial Sequence
  Description of Artificial Sequence: Synthetic polypeptide
CEANEIATTNPVAYEAWGVVWPGPNNENDGEQNGEE

SEQ ID NO: 205451 - protein, 39 aa, Artificial Sequence
  Description of Artificial Sequence: Synthetic polypeptide
DEEEISCTNPVATEGYGQCVCSNWGEDHNAENFNSETQN

SEQ ID NO: 205452 - protein, 38 aa, Artificial Sequence
  Description of Artificial Sequence: Synthetic polypeptide
DDEEISCTNPVAYEQYGCVCSNWGEDHNAENFNSDTQP

SEQ ID NO: 205453 - protein, 39 aa, Artificial Sequence
  Description of Artificial Sequence: Synthetic polypeptide
DEEEISCTNPVATEGYGQCVCSNWGEDHNAENFNSENQS

SEQ ID NO: 205454 - protein, 39 aa, Artificial Sequence
  Description of Artificial Sequence: Synthetic polypeptide
DEEEISCTNPVATEGYGQCVCSNWGEDHNAENFNSDTQA

SEQ ID NO: 205455 - protein, 39 aa, Artificial Sequence
  Description of Artificial Sequence: Synthetic polypeptide
DEEEISCTNPVATEGYGQCVCSMWGEDHNAENFNSDTQA

SEQ ID NO: 205456 - protein, 39 aa, Artificial Sequence
  Description of Artificial Sequence: Synthetic polypeptide
DEAEISTTNPVAYEQYGQCVCSNWEEDHNAEGFNSDTAS

SEQ ID NO: 205457 - protein, 38 aa, Artificial Sequence
  Description of Artificial Sequence: Synthetic polypeptide
SDEEISTTNPVATEGYGCVCSNWGEDHNAENFNSDFQS

SEQ ID NO: 205458 - protein, 36 aa, Artificial Sequence
  Description of Artificial Sequence: Synthetic polypeptide
DEMEIRTTNPIATECWGATTCSAAEDWVAEPKGPYI

SEQ ID NO: 205459 - protein, 40 aa, Artificial Sequence
  Description of Artificial Sequence: Synthetic polypeptide
CEEEIATTNPVAYYYEPQWGCVAGGTNELEAGNPQENTNE

SEQ ID NO: 205460 - protein, 38 aa, Artificial Sequence
  Description of Artificial Sequence: Synthetic polypeptide
DDECIRTTNPVATEGYGQCVCSNWGEHNIENFISDTQA

SEQ ID NO: 205461 - protein, 39 aa, Artificial Sequence
  Description of Artificial Sequence: Synthetic polypeptide
AEEEVIATTNPVAYEQWGCVTAGSGAGLPEATADGNTAN

SEQ ID NO: 205462 - protein, 39 aa, Artificial Sequence
  Description of Artificial Sequence: Synthetic polypeptide
SDEEISTTNPVATEQYGQCVCSNWEEDDNAENFNSDTQS

SEQ ID NO: 205463 - protein, 39 aa, Artificial Sequence
  Description of Artificial Sequence: Synthetic polypeptide
SDEEISTTNPVATEQYGQCVCSNWGEDDNAENFNSDNQS

SEQ ID NO: 205464 - protein, 39 aa, Artificial Sequence
  Description of Artificial Sequence: Synthetic polypeptide
SDEEISTTNPVATEQYGQCVCSNWGEDHNAEGFNSDTQA

SEQ ID NO: 205465 - protein, 38 aa, Artificial Sequence
  Description of Artificial Sequence: Synthetic polypeptide
DEDEIRATNPVATEQWGGCCAANNGVEDVGMAMDENTD

SEQ ID NO: 205466 - protein, 38 aa, Artificial Sequence
  Description of Artificial Sequence: Synthetic polypeptide
DEGETEIATTNPCAYECWGTVCSTWINDNQGIDQDDHS

SEQ ID NO: 205467 - protein, 37 aa, Artificial Sequence
  Description of Artificial Sequence: Synthetic polypeptide
VEEEIACTNPVATEQWGANPCNAAQATGQPPGEGQGS

SEQ ID NO: 205468 - protein, 39 aa, Artificial Sequence
  Description of Artificial Sequence: Synthetic polypeptide
SDEEISTTNPVATEQYGQCVCSNWGEDHNAENFNSQTQS

SEQ ID NO: 205469 - protein, 39 aa, Artificial Sequence
  Description of Artificial Sequence: Synthetic polypeptide
SDEEISTTNPVATEQYGQCVCSNWGEDHNDENFNSDTQA

SEQ ID NO: 205470 - protein, 38 aa, Artificial Sequence
  Description of Artificial Sequence: Synthetic polypeptide
AEEEISTTNPVSTEQYGQCVCGNWGEDNAEGFISQTQS

SEQ ID NO: 205471 - protein, 39 aa, Artificial Sequence
  Description of Artificial Sequence: Synthetic polypeptide
DDEEISCTNPVATEQYGQCVCSNWGEDDNQEYSGSQTQA

SEQ ID NO: 205472 - protein, 39 aa, Artificial Sequence
  Description of Artificial Sequence: Synthetic polypeptide
DDEEISCTNPVATEQYGQCVCSNWGEDHNAEFFNSDTQG

SEQ ID NO: 205473 - protein, 38 aa, Artificial Sequence
  Description of Artificial Sequence: Synthetic polypeptide
AEMEISTTNPVAYEQYGQCVCSNWGEPNAENFNSDTQA

SEQ ID NO: 205474 - protein, 39 aa, Artificial Sequence
  Description of Artificial Sequence: Synthetic polypeptide
SDEEISTTNPVATEQYGQCVCSNWGEDHNAENFNSDFQA

SEQ ID NO: 205475 - protein, 39 aa, Artificial Sequence
  Description of Artificial Sequence: Synthetic polypeptide
DEEEIGTTNPVAYEQYGQCVCSNWGEDHNAENFISDTQA

SEQ ID NO: 205476 - protein, 38 aa, Artificial Sequence
  Description of Artificial Sequence: Synthetic polypeptide
AEMEISTTNPVAYEQYGQCVCSNWGEHNQENFNSDNQG

SEQ ID NO: 205477 - protein, 38 aa, Artificial Sequence
  Description of Artificial Sequence: Synthetic polypeptide
DEMCIACTNPVATEQYGCVCSNWGEDDNAEHFISENQA

SEQ ID NO: 205478 - protein, 37 aa, Artificial Sequence
  Description of Artificial Sequence: Synthetic polypeptide
YEEFTIFITTNSPATEQYGSDQCTGDFGTQRVVVIIS

SEQ ID NO: 205479 - protein, 37 aa, Artificial Sequence
  Description of Artificial Sequence: Synthetic polypeptide
CAEEIATTNPVATEQWGCNVAGQATGPAEAAIGDTGE

SEQ ID NO: 205480 - protein, 39 aa, Artificial Sequence
  Description of Artificial Sequence: Synthetic polypeptide
DEAEISTTNPVAYEQYGQCVCSNWEEDHNAENFISDNQS

SEQ ID NO: 205481 - protein, 36 aa, Artificial Sequence
  Description of Artificial Sequence: Synthetic polypeptide
YEEFTIFIPTNSPATEQYGSDQCTTMDGTQRVVFIS

SEQ ID NO: 205482 - protein, 38 aa, Artificial Sequence
  Description of Artificial Sequence: Synthetic polypeptide
DEDEIATTNPVATEQWGTCCAGTGDHPGENHPDDSDNN

SEQ ID NO: 205483 - protein, 39 aa, Artificial Sequence
  Description of Artificial Sequence: Synthetic polypeptide
DEAEISTTNPVAYEQYGQCVCSNWGPDHNAENFNSDTQA

SEQ ID NO: 205484 - protein, 39 aa, Artificial Sequence
  Description of Artificial Sequence: Synthetic polypeptide
DDEEISCTNPVATEQYGQCVCSNWGEDHNAENFNSDTQA

SEQ ID NO: 205485 - protein, 38 aa, Artificial Sequence
  Description of Artificial Sequence: Synthetic polypeptide
DEAEISTTNPVAYEGYGQCVCSNWGEHNAENFNSDNQF

SEQ ID NO: 205486 - protein, 39 aa, Artificial Sequence
  Description of Artificial Sequence: Synthetic polypeptide
DERCISTTNPVATEGYGQCVCSNWGEDDNTENFNSDNQS

SEQ ID NO: 205487 - protein, 38 aa, Artificial Sequence
  Description of Artificial Sequence: Synthetic polypeptide
DEECIRTTNPEAYEQYGQCVCPNWGEDNAEYFNSDTQS

SEQ ID NO: 205488 - protein, 36 aa, Artificial Sequence
  Description of Artificial Sequence: Synthetic polypeptide
TTEIDEIATTNPVAYEQWGTCVCENNDNHHTQDNHS

SEQ ID NO: 205489 - protein, 36 aa, Artificial Sequence
  Description of Artificial Sequence: Synthetic polypeptide
NENNEIATTNPVAYEAWGVVWPGPNNENDGEQNGEA

SEQ ID NO: 205490 - protein, 37 aa, Artificial Sequence
  Description of Artificial Sequence: Synthetic polypeptide
AENAIACTNPVATEQYGCSCSNWGEDNAEYFSSDNQS

SEQ ID NO: 205491 - protein, 38 aa, Artificial Sequence
  Description of Artificial Sequence: Synthetic polypeptide
AEMVIGTTNPVATEQWGCVCSTWGDDDNAEYFGSDTQA

SEQ ID NO: 205492 - protein, 37 aa, Artificial Sequence
  Description of Artificial Sequence: Synthetic polypeptide
YEEFIFITTNSPATEQYGSDQCHTMDGQQPRNVVVIF

SEQ ID NO: 205493 - protein, 37 aa, Artificial Sequence
  Description of Artificial Sequence: Synthetic polypeptide
SDEEIRTTNPVATEGWGCVCSNWGEDNAENFISDTQA

SEQ ID NO: 205494 - protein, 35 aa, Artificial Sequence
  Description of Artificial Sequence: Synthetic polypeptide
DDSEVASTNPVSTEGYGQCVCQNSEIQEYFGSQQS

SEQ ID NO: 205495 - protein, 39 aa, Artificial Sequence
  Description of Artificial Sequence: Synthetic polypeptide
DEAEISTTNPVAYEQYGQCVCSNWGEDHNQEYFNSETQS

SEQ ID NO: 205496 - protein, 36 aa, Artificial Sequence
  Description of Artificial Sequence: Synthetic polypeptide
QEGEIAPTNPCSYEWYGVTVSCCNMLSNNSNGGTDR

SEQ ID NO: 205497 - protein, 38 aa, Artificial Sequence
  Description of Artificial Sequence: Synthetic polypeptide
DEAEISTTNPVAYEGYGQCVCSNWGEHNAENFNSDTQL

SEQ ID NO: 205498 - protein, 38 aa, Artificial Sequence
  Description of Artificial Sequence: Synthetic polypeptide
SEEEIRCTNPCAYEQYGQCVCSWGEGDNAENFGSDTQS

SEQ ID NO: 205499 - protein, 39 aa, Artificial Sequence
  Description of Artificial Sequence: Synthetic polypeptide
AEEEISTTNPVAYEQYGQCVCSNWGEDHNAENFNSDTQL

SEQ ID NO: 205500 - protein, 40 aa, Artificial Sequence
  Description of Artificial Sequence: Synthetic polypeptide
VEAEIRTTNPVATEQYGDVVVGDGQEDQEEQDNEGEGNGV

SEQ ID NO: 205501 - protein, 39 aa, Artificial Sequence
  Description of Artificial Sequence: Synthetic polypeptide
DEECIGTTNPVATEQYGQCVCSNWGEDHDAENFNSETQS

SEQ ID NO: 205502 - protein, 39 aa, Artificial Sequence
  Description of Artificial Sequence: Synthetic polypeptide
AEEEISTTNPVAYEQYGQCVCSNWGEDHNAENFNSDTQA

SEQ ID NO: 205503 - protein, 39 aa, Artificial Sequence
  Description of Artificial Sequence: Synthetic polypeptide
AEECIRTTNPVAYEQYGQCVCSNWGEDHNTENFNSDTQS

SEQ ID NO: 205504 - protein, 39 aa, Artificial Sequence
  Description of Artificial Sequence: Synthetic polypeptide
DEECIIATTNPVAYEPYGKTVASNQFELSQPPDSTNNQS

SEQ ID NO: 205505 - protein, 39 aa, Artificial Sequence
  Description of Artificial Sequence: Synthetic polypeptide
CEAEISTTNPVATEQYGQCVCSNWGEDHNAENFGSDTQS

SEQ ID NO: 205506 - protein, 39 aa, Artificial Sequence
  Description of Artificial Sequence: Synthetic polypeptide
AEEEISTTNPVAYEQYGQCVCSNWGEDHNAEYFNSDTQA

SEQ ID NO: 205507 - protein, 35 aa, Artificial Sequence
  Description of Artificial Sequence: Synthetic polypeptide
DEHEIATTNPIATECWGATTWANAIDWAEPKGPYI

SEQ ID NO: 205508 - protein, 39 aa, Artificial Sequence
  Description of Artificial Sequence: Synthetic polypeptide
DDEAISTTNPVATEQYGQCVCSNWGEDHNAENFGSDTQS

SEQ ID NO: 205509 - protein, 39 aa, Artificial Sequence
  Description of Artificial Sequence: Synthetic polypeptide
AEEEISTTNPVAYEQYGQCVCSNWGEDHNQEYFNSDNQS

SEQ ID NO: 205510 - protein, 37 aa, Artificial Sequence
  Description of Artificial Sequence: Synthetic polypeptide
VEEEIACTNPVATESYGTACAAANPAEADAEIGNNTA

SEQ ID NO: 205511 - protein, 39 aa, Artificial Sequence
  Description of Artificial Sequence: Synthetic polypeptide
AEEEISTTNPVAYEQYGQCVCSNWGEDPNEENFGSDTQA

SEQ ID NO: 205512 - protein, 39 aa, Artificial Sequence
  Description of Artificial Sequence: Synthetic polypeptide
DEAEISTTNPVAYEGYGQCVCSNWGELHNAEGFNSDNQS

SEQ ID NO: 205513 - protein, 36 aa, Artificial Sequence
  Description of Artificial Sequence: Synthetic polypeptide
CAEEIATTNPVAYAQWGCNTAGNNGLTTAEEGNMDS

SEQ ID NO: 205514 - protein, 39 aa, Artificial Sequence
  Description of Artificial Sequence: Synthetic polypeptide
DEMEISTTNPVAYEQYGQCVCSNWGEDHNAEGFNSDNQS

SEQ ID NO: 205515 - protein, 39 aa, Artificial Sequence
  Description of Artificial Sequence: Synthetic polypeptide
AEEEISTTNPVAYEQYGQCVCSNWGEDDNIEFFNSDTQS

SEQ ID NO: 205516 - protein, 38 aa, Artificial Sequence
  Description of Artificial Sequence: Synthetic polypeptide
DEECIATVNPVATEGYGCVCSNWGEDHNEENFNSDTQS

SEQ ID NO: 205517 - protein, 39 aa, Artificial Sequence
  Description of Artificial Sequence: Synthetic polypeptide
DEMEISTTNPVAYEQYGQCVCSNWGEDHNAENFNSDTQA

SEQ ID NO: 205518 - protein, 38 aa, Artificial Sequence
  Description of Artificial Sequence: Synthetic polypeptide
SDECISTTNPVATEQYGCVCSMSGEDHNAENFNSDTQA

SEQ ID NO: 205519 - protein, 38 aa, Artificial Sequence
  Description of Artificial Sequence: Synthetic polypeptide
SEEEIRCTNPCAYEQYGCVCSNWMEDDNAENFGSDTQS

SEQ ID NO: 205520 - protein, 39 aa, Artificial Sequence
  Description of Artificial Sequence: Synthetic polypeptide
AEMEISTTNPVATEQYGQCVCSNWGEDHNEENFNSDNQM

SEQ ID NO: 205521 - protein, 37 aa, Artificial Sequence
  Description of Artificial Sequence: Synthetic polypeptide
SEEEIRCTNPCAYEQYGCVCSNWMEHNAENFMSDTQS

SEQ ID NO: 205522 - protein, 37 aa, Artificial Sequence
  Description of Artificial Sequence: Synthetic polypeptide
VEEEIATTNPVATAQWGGCWCAGNFAGLEATANGEFT

SEQ ID NO: 205523 - protein, 39 aa, Artificial Sequence
  Description of Artificial Sequence: Synthetic polypeptide
AEEEISTTNPVAYEQYGQCVCSNWGEDHNAEGFNSDTQA

SEQ ID NO: 205524 - protein, 39 aa, Artificial Sequence
  Description of Artificial Sequence: Synthetic polypeptide
CEAEISTTNPVATEQYGQCVCGTWGEDHNQENFGSETQS

SEQ ID NO: 205525 - protein, 39 aa, Artificial Sequence
  Description of Artificial Sequence: Synthetic polypeptide
AEEEISTTNPVAYEQYGQCVCSNWGEDHNAEHFNSDTQG

SEQ ID NO: 205526 - protein, 39 aa, Artificial Sequence
  Description of Artificial Sequence: Synthetic polypeptide
DEAEISTTNPVAYEQYGQCVCSNWGEDHNAENSNSDTQA

SEQ ID NO: 205527 - protein, 39 aa, Artificial Sequence
  Description of Artificial Sequence: Synthetic polypeptide
DEMEISTTNPVAYEQYGQCVCSNWGEDHNAENFNSDTQS

SEQ ID NO: 205528 - protein, 39 aa, Artificial Sequence
  Description of Artificial Sequence: Synthetic polypeptide
DEMEISTTNPVAYEQYGQCVCSNWGEDHNAENFNSDTQL

SEQ ID NO: 205529 - protein, 36 aa, Artificial Sequence
  Description of Artificial Sequence: Synthetic polypeptide
DENCIATVNPVATECYGEVVCIDHQQDQERQQIEGT

SEQ ID NO: 205530 - protein, 36 aa, Artificial Sequence
  Description of Artificial Sequence: Synthetic polypeptide
CEDEIACTNPVATEQWGCVAGNPGDPPDAGGDITAH

SEQ ID NO: 205531 - protein, 37 aa, Artificial Sequence
  Description of Artificial Sequence: Synthetic polypeptide
CEDEIACTNPVATEQWGCTTAGNNGENNTMLGDGMNP

SEQ ID NO: 205532 - protein, 40 aa, Artificial Sequence
  Description of Artificial Sequence: Synthetic polypeptide
DEEEIRTTNPVAYEQYGQCAVCSNSGEDHNQENFPSETQA

SEQ ID NO: 205533 - protein, 38 aa, Artificial Sequence
  Description of Artificial Sequence: Synthetic polypeptide
DEAEISTTNPVAYEGYGQCVCSNWGEHNAENFNSDTQA

SEQ ID NO: 205534 - protein, 37 aa, Artificial Sequence
  Description of Artificial Sequence: Synthetic polypeptide
FEEEICMNNPVATEDYYGFTRVCIPWPQPLQEAFGKG

SEQ ID NO: 205535 - protein, 37 aa, Artificial Sequence
  Description of Artificial Sequence: Synthetic polypeptide
DEMEISTTNPVSYEQYGCVCGNWGEHNAEGFGSQTQA

SEQ ID NO: 205536 - protein, 37 aa, Artificial Sequence
  Description of Artificial Sequence: Synthetic polypeptide
ADNEIATTNPVATEGYGCVCSNWGEHNQEHFISENQA

SEQ ID NO: 205537 - protein, 39 aa, Artificial Sequence
  Description of Artificial Sequence: Synthetic polypeptide
DENEIRTTNPVATEGWGQCVTSNSMEDENAENFNSDTQA

SEQ ID NO: 205538 - protein, 36 aa, Artificial Sequence
  Description of Artificial Sequence: Synthetic polypeptide
CEDEIACTNPVATEQWGCMFANNGQNPETLENGEEA

SEQ ID NO: 205539 - protein, 36 aa, Artificial Sequence
  Description of Artificial Sequence: Synthetic polypeptide
ADNEIATTNPVATEGYGCVCSNWGEDNQHFISETQA

SEQ ID NO: 205540 - protein, 35 aa, Artificial Sequence
  Description of Artificial Sequence: Synthetic polypeptide
DEESIACTNPVATASWGCVAGTGEPGPDDSPNHMD

SEQ ID NO: 205541 - protein, 37 aa, Artificial Sequence
  Description of Artificial Sequence: Synthetic polypeptide
CETEIACTNPVATEQYGSACAANPAEGQDHQDDSWAK

SEQ ID NO: 205542 - protein, 38 aa, Artificial Sequence
  Description of Artificial Sequence: Synthetic polypeptide
DEMCIACTNPVATEQYGQCVCSNWGEDNAEHFNSENQA

SEQ ID NO: 205543 - protein, 39 aa, Artificial Sequence
  Description of Artificial Sequence: Synthetic polypeptide
CEEEIRCTNPVAYEQYGQCVCSNWGEDHNAENFISDNQS

SEQ ID NO: 205544 - protein, 38 aa, Artificial Sequence
  Description of Artificial Sequence: Synthetic polypeptide
DDEEISTTNPCATEGYGQCVCSNWGEHNAENFNSDTQS

SEQ ID NO: 205545 - protein, 39 aa, Artificial Sequence
  Description of Artificial Sequence: Synthetic polypeptide
DEAEISTTNPVAYEQYGQCVCSNWGEDHNIENFNSDNQG

SEQ ID NO: 205546 - protein, 39 aa, Artificial Sequence
  Description of Artificial Sequence: Synthetic polypeptide
DENEIRTTNPVATEGWGQCVTSNWGEDPNTENFISDTQS

SEQ ID NO: 205547 - protein, 36 aa, Artificial Sequence
  Description of Artificial Sequence: Synthetic polypeptide
CEDEIACTNPVATEQWGCVAGNGVGPAEATAGGIDA

SEQ ID NO: 205548 - protein, 37 aa, Artificial Sequence
  Description of Artificial Sequence: Synthetic polypeptide
QEDEIATTNPVAYEQWGCVAAGEGPGNNAAGNPNADP

SEQ ID NO: 205549 - protein, 37 aa, Artificial Sequence
  Description of Artificial Sequence: Synthetic polypeptide
CEDEIACTNPVATEQWGCNTAGCGELPQANIQDGSNE

SEQ ID NO: 205550 - protein, 39 aa, Artificial Sequence
  Description of Artificial Sequence: Synthetic polypeptide
AEEEISTTNPVAYEQYGQCVCSNWGEGHNAENFNSDNQL

SEQ ID NO: 205551 - protein, 39 aa, Artificial Sequence
  Description of Artificial Sequence: Synthetic polypeptide
DEAEISTTNPVAYEQYGQCVCSNWGEDHNAEYFNSDTQS

SEQ ID NO: 205552 - protein, 35 aa, Artificial Sequence
  Description of Artificial Sequence: Synthetic polypeptide
DEHEIATTNPIATECWGATYYANENDGHEHTGKQM

SEQ ID NO: 205553 - protein, 37 aa, Artificial Sequence
  Description of Artificial Sequence: Synthetic polypeptide
DEMCISTTNPVATCQYGCVCSNWGEHNEENFISDTQS

SEQ ID NO: 205554 - protein, 39 aa, Artificial Sequence
  Description of Artificial Sequence: Synthetic polypeptide
CEAEISTTNPVATEQYGQCVCSNWGPDHNAENFNSDTQA

SEQ ID NO: 205555 - protein, 38 aa, Artificial Sequence
  Description of Artificial Sequence: Synthetic polypeptide
DENEIRTTNPVATEGWGCVTQNWGEDHNTENFISDTAS

SEQ ID NO: 205556 - protein, 37 aa, Artificial Sequence
  Description of Artificial Sequence: Synthetic polypeptide
CEDEIACTNPVATEQWGCNCNAASNLDQDAPDGEIMH

SEQ ID NO: 205557 - protein, 38 aa, Artificial Sequence
  Description of Artificial Sequence: Synthetic polypeptide
CEAEISTTNPVATEYYGQCVCSWGEDHNIENFNSDTQA

SEQ ID NO: 205558 - protein, 39 aa, Artificial Sequence
  Description of Artificial Sequence: Synthetic polypeptide
AEEEISTTNPVAYEQYGQCVCSNWGEGHNIESFNSENQS

SEQ ID NO: 205559 - protein, 38 aa, Artificial Sequence
  Description of Artificial Sequence: Synthetic polypeptide
AEEEISTTNPVAYEQYGQCVCSNWGEHNAENFFSETQA

SEQ ID NO: 205560 - protein, 38 aa, Artificial Sequence
  Description of Artificial Sequence: Synthetic polypeptide
DDEAISTTNPVAYEQYGQCVCSNWGEHNAENFGSDTQA

SEQ ID NO: 205561 - protein, 37 aa, Artificial Sequence
  Description of Artificial Sequence: Synthetic polypeptide
AENEIACTNPCATEQYGCSCSNWGEDNQEYFNSDTQS

SEQ ID NO: 205562 - protein, 38 aa, Artificial Sequence
  Description of Artificial Sequence: Synthetic polypeptide
ADAEISTTNPVATEQYGQCVCSNWGEHNAENFNSDTQS

SEQ ID NO: 205563 - protein, 37 aa, Artificial Sequence
  Description of Artificial Sequence: Synthetic polypeptide
TTEECIACTNPVAYEQWGSCVTIDQGNQQKETGDVIM

SEQ ID NO: 205564 - protein, 39 aa, Artificial Sequence
  Description of Artificial Sequence: Synthetic polypeptide
DDEAISTTNPVATEQYGQCVCSNWGEPHNAENFNSDTQA

SEQ ID NO: 205565 - protein, 39 aa, Artificial Sequence
  Description of Artificial Sequence: Synthetic polypeptide
DDEEISTTNPVATEQYGQCVCSNWGEDDNAENFISETQP

SEQ ID NO: 205566 - protein, 37 aa, Artificial Sequence
  Description of Artificial Sequence: Synthetic polypeptide
VEDEIACTNPVATEQWGCVAGNNPAGGQAHQGDQTAE

SEQ ID NO: 205567 - protein, 39 aa, Artificial Sequence
  Description of Artificial Sequence: Synthetic polypeptide
DEAEISTTNPVAYEQYGQCVCSNWGEDHNAENFISDNQS

SEQ ID NO: 205568 - protein, 37 aa, Artificial Sequence
  Description of Artificial Sequence: Synthetic polypeptide
CEEEIACTNPVATEQYGCNNAGNNGLVGTMADDSAAE

SEQ ID NO: 205569 - protein, 38 aa, Artificial Sequence
  Description of Artificial Sequence: Synthetic polypeptide
DEMCIGTTNPVATEQWGCVCSNWGDDDNQEYFNSDTQA

SEQ ID NO: 205570 - protein, 38 aa, Artificial Sequence
  Description of Artificial Sequence: Synthetic polypeptide
DEAEISTTNPVAYEQYGCVCPNWGEDHNAENFNSETQN

SEQ ID NO: 205571 - protein, 39 aa, Artificial Sequence
  Description of Artificial Sequence: Synthetic polypeptide
DEDEIRTTNPCATEAYGVVATTNANANDETGTEEGSTIP

SEQ ID NO: 205572 - protein, 38 aa, Artificial Sequence
  Description of Artificial Sequence: Synthetic polypeptide
AEAEISTTNPVAYEQYGCVCSNWGEDHNAENFNSETQP

SEQ ID NO: 205573 - protein, 38 aa, Artificial Sequence
  Description of Artificial Sequence: Synthetic polypeptide
CDAEISTTNPVATCQYGCVCSTWGEDHNAENFNSDNQA

SEQ ID NO: 205574 - protein, 38 aa, Artificial Sequence
  Description of Artificial Sequence: Synthetic polypeptide
SEECISTTNPVAYEQYGQCVCSMWGEHNAENFNSDTQA

SEQ ID NO: 205575 - protein, 38 aa, Artificial Sequence
  Description of Artificial Sequence: Synthetic polypeptide
SEECISTTNPVAYEQYGQCVCGNSGEHNAENFNSDTQS

SEQ ID NO: 205576 - protein, 39 aa, Artificial Sequence
  Description of Artificial Sequence: Synthetic polypeptide
DEDEIRTTNPCATEAYGVVATTNANANDETGTEEGSVGS

SEQ ID NO: 205577 - protein, 38 aa, Artificial Sequence
  Description of Artificial Sequence: Synthetic polypeptide
AEAEISTTNPVAYEQYGCVCSNWGEDHNAENFNSDTQS

SEQ ID NO: 205578 - protein, 39 aa, Artificial Sequence
  Description of Artificial Sequence: Synthetic polypeptide
DEDEIRTTNPCATEAYGVVATTNANANDETGTEEGTIYI

SEQ ID NO: 205579 - protein, 38 aa, Artificial Sequence
  Description of Artificial Sequence: Synthetic polypeptide
AEAEISTTNPVAYEQYGCVCSNWEEDHNAENFNSDTQA

SEQ ID NO: 205580 - protein, 37 aa, Artificial Sequence
  Description of Artificial Sequence: Synthetic polypeptide
CDAEISTTNPVATEGYGCVCSNWEEHNAESFNSDNQA

SEQ ID NO: 205581 - protein, 39 aa, Artificial Sequence
  Description of Artificial Sequence: Synthetic polypeptide
DEDEIRTTNPCATEAYGVVATTNANANDETGTEEGTVTD

SEQ ID NO: 205582 - protein, 39 aa, Artificial Sequence
  Description of Artificial Sequence: Synthetic polypeptide
DEDEIRTTNPCATEAYGVVATTNANANDTGTEEGSTTDM

SEQ ID NO: 205583 - protein, 39 aa, Artificial Sequence
  Description of Artificial Sequence: Synthetic polypeptide
AEECIRTTNPVATEGYGICVTSTWGADHNAENFISDPQA

SEQ ID NO: 205584 - protein, 38 aa, Artificial Sequence
  Description of Artificial Sequence: Synthetic polypeptide
AEECIRTTNPVATEGYGICVCSNWGEDNAENFISDTQS

SEQ ID NO: 205585 - protein, 39 aa, Artificial Sequence
  Description of Artificial Sequence: Synthetic polypeptide
AEMEIATTNPVATEQYGQCVCSNWGEDHNAEHFISENQS

SEQ ID NO: 205586 - protein, 38 aa, Artificial Sequence
  Description of Artificial Sequence: Synthetic polypeptide
SAQEIATTNPVAYEQWGSNCASTTEGGPEASGGDNDRD

SEQ ID NO: 205587 - protein, 36 aa, Artificial Sequence
  Description of Artificial Sequence: Synthetic polypeptide
SAQEIATTNPVAYEQWGSVCAMNNGGETPIGGGEMW

SEQ ID NO: 205588 - protein, 39 aa, Artificial Sequence
  Description of Artificial Sequence: Synthetic polypeptide
AEMEIATTNPVATEQYGQCVCSNWGEDPNAEFFNSDTQA

SEQ ID NO: 205589 - protein, 35 aa, Artificial Sequence
  Description of Artificial Sequence: Synthetic polypeptide
DDSEVASTNPVSYEGYGKTVACNTEISQSATGGQR

SEQ ID NO: 205590 - protein, 37 aa, Artificial Sequence
  Description of Artificial Sequence: Synthetic polypeptide
AEAEISTTNPVAYEQYGCICSNWGEHNEENFPSDNQA

SEQ ID NO: 205591 - protein, 38 aa, Artificial Sequence
  Description of Artificial Sequence: Synthetic polypeptide
DEMEISTTNPVAYEQYGICVCSNWGEPNAEFFMSDTQA

SEQ ID NO: 205592 - protein, 39 aa, Artificial Sequence
  Description of Artificial Sequence: Synthetic polypeptide
DEAEISTTNPVAYEQYGQCVCSNWGEDDNAENFNSETQS

SEQ ID NO: 205593 - protein, 39 aa, Artificial Sequence
  Description of Artificial Sequence: Synthetic polypeptide
DEEQIATTNPVAYEPQWGHSACAAANGQDAEQAGNDQHQ

SEQ ID NO: 205594 - protein, 39 aa, Artificial Sequence
  Description of Artificial Sequence: Synthetic polypeptide
DEIEIRTTNCVATEQYGDYAVNMDPGIPNGEFGVEEGEA

SEQ ID NO: 205595 - protein, 35 aa, Artificial Sequence
  Description of Artificial Sequence: Synthetic polypeptide
NESEIRTTNPCSTEPWGCIAPEDGQQQQQQQGTNS

SEQ ID NO: 205596 - protein, 39 aa, Artificial Sequence
  Description of Artificial Sequence: Synthetic polypeptide
DEDEIRTTNPCATEAYGVVATTNANANETGTEEGATTIG

SEQ ID NO: 205597 - protein, 38 aa, Artificial Sequence
  Description of Artificial Sequence: Synthetic polypeptide
AEAEISTTNPVAYEQYGCVCSMWGEDHNAENFNSDTQA

SEQ ID NO: 205598 - protein, 38 aa, Artificial Sequence
  Description of Artificial Sequence: Synthetic polypeptide
SAQQIATTNPVAYEQWGSVCSPPTEGGNNAVGGDNMAD

SEQ ID NO: 205599 - protein, 38 aa, Artificial Sequence
  Description of Artificial Sequence: Synthetic polypeptide
DEMCIGTTNPVATEQWGCVCSNWGEDPNQEYFGSDTQA

SEQ ID NO: 205600 - protein, 38 aa, Artificial Sequence
  Description of Artificial Sequence: Synthetic polypeptide
SEECVRTTNPVATEQYGQCVCSNWGEHDAEYINSDTQS

SEQ ID NO: 205601 - protein, 41 aa, Artificial Sequence
  Description of Artificial Sequence: Synthetic polypeptide
DEKDEITRWTANYVVATTEQFDGYSQVHGILNLFFTAGNRY

SEQ ID NO: 205602 - protein, 35 aa, Artificial Sequence
  Description of Artificial Sequence: Synthetic polypeptide
SEAQIASTNPVGYEAYGQVVMAYSPGLSQHVGDTI

SEQ ID NO: 205603 - protein, 35 aa, Artificial Sequence
  Description of Artificial Sequence: Synthetic polypeptide
AETEIRTTNPIATECWGATAWANAEDWAEPKGPYI

SEQ ID NO: 205604 - protein, 39 aa, Artificial Sequence
  Description of Artificial Sequence: Synthetic polypeptide
DEAEISTTNPVATEQYGQCVCSNWGEDHNAENFISDTQQ

SEQ ID NO: 205605 - protein, 39 aa, Artificial Sequence
  Description of Artificial Sequence: Synthetic polypeptide
DEAEISTTNPVATEQYGQCVCSNWGEDHNAENFISDTQS

SEQ ID NO: 205606 - protein, 40 aa, Artificial Sequence
  Description of Artificial Sequence: Synthetic polypeptide
CEAEIRTTNPVATEQYGDVVVGEGQEDQEEQDGEGEGNGV

SEQ ID NO: 205607 - protein, 37 aa, Artificial Sequence
  Description of Artificial Sequence: Synthetic polypeptide
DEDEIATTNPVAYEQWGTIICPAVADAGQDHQGDSMN

SEQ ID NO: 205608 - protein, 37 aa, Artificial Sequence
  Description of Artificial Sequence: Synthetic polypeptide
DEDEIATTNPVAYEQWGTIICPAVADAGVDHQGDNME

SEQ ID NO: 205609 - protein, 38 aa, Artificial Sequence
  Description of Artificial Sequence: Synthetic polypeptide
AEACISTTNPVATEQYGCVCSNWGEDHNAENFNSDTQS

SEQ ID NO: 205610 - protein, 38 aa, Artificial Sequence
  Description of Artificial Sequence: Synthetic polypeptide
AEECISCTNPVATEQYGQCVCSNWGEHNAENFNSDTQS

SEQ ID NO: 205611 - protein, 38 aa, Artificial Sequence
  Description of Artificial Sequence: Synthetic polypeptide
SEEEIRCTNPCATEGYGCVCSNWGEDHNAENFGSDTQS

SEQ ID NO: 205612 - protein, 37 aa, Artificial Sequence
  Description of Artificial Sequence: Synthetic polypeptide
DEDEIATTNPVAYEQWGTNCAAGAGELPDSMGPNEAH

SEQ ID NO: 205613 - protein, 36 aa, Artificial Sequence
  Description of Artificial Sequence: Synthetic polypeptide
QEDEIRGTNPVATEAWGNCSAIAGEGQDGQGGQTGD

SEQ ID NO: 205614 - protein, 36 aa, Artificial Sequence
  Description of Artificial Sequence: Synthetic polypeptide
DEMCISTTNPLATEQWGCVCSWGEHNQESFISDTQA

SEQ ID NO: 205615 - protein, 35 aa, Artificial Sequence
  Description of Artificial Sequence: Synthetic polypeptide
ENAEIATVNPVAYEQWGCVTGNGNEGEQDGQGETQ

SEQ ID NO: 205616 - protein, 38 aa, Artificial Sequence
  Description of Artificial Sequence: Synthetic polypeptide
DDEEISTTNPVAYEAYGQCVCSNWGEHNAENFNSDTQS

SEQ ID NO: 205617 - protein, 37 aa, Artificial Sequence
  Description of Artificial Sequence: Synthetic polypeptide
DEDEIATTNPVAYEQWGTNCAAEAGELPDSMGPNEHW

SEQ ID NO: 205618 - protein, 36 aa, Artificial Sequence
  Description of Artificial Sequence: Synthetic polypeptide
DENEIATTNPCLYYEPYGTTSAMEWDQQQQNGENVH

SEQ ID NO: 205619 - protein, 38 aa, Artificial Sequence
  Description of Artificial Sequence: Synthetic polypeptide
AEACISTTNPVATEQYGCVCSNWGEDHNIENFNSDTQG

SEQ ID NO: 205620 - protein, 38 aa, Artificial Sequence
  Description of Artificial Sequence: Synthetic polypeptide
QENEIKTTNPVATEFYGCVVANNDGFITQDEGGEDGQE

SEQ ID NO: 205621 - protein, 39 aa, Artificial Sequence
  Description of Artificial Sequence: Synthetic polypeptide
DEDEIRTTNPCATEAYGVVATTNANAGDTIGTEEGSIGI

SEQ ID NO: 205622 - protein, 39 aa, Artificial Sequence
  Description of Artificial Sequence: Synthetic polypeptide
DEDEIRTTNPCATEAYGVVATTNANAEDTIGTEEGTIYI

SEQ ID NO: 205623 - protein, 37 aa, Artificial Sequence
  Description of Artificial Sequence: Synthetic polypeptide
QESEIAPTNPCGYEQYGVTVSCWGHMLSQNSNVGTDR

SEQ ID NO: 205624 - protein, 36 aa, Artificial Sequence
  Description of Artificial Sequence: Synthetic polypeptide
DDSEVASTNPVSYEGYGNTVACNTEISQSRTGGQTR

SEQ ID NO: 205625 - protein, 39 aa, Artificial Sequence
  Description of Artificial Sequence: Synthetic polypeptide
DEAEISTTNPVATEQYGQCVCSNWGEDHNAENFISDTQA

SEQ ID NO: 205626 - protein, 38 aa, Artificial Sequence
  Description of Artificial Sequence: Synthetic polypeptide
FEEEIRITVNPDATEQYGNFFVVEVNQEVWRNTVQVVI

SEQ ID NO: 205627 - protein, 39 aa, Artificial Sequence
  Description of Artificial Sequence: Synthetic polypeptide
AEECISTTNPVATEQYGQCQVCSNWEEHNAENFNSDTQA

SEQ ID NO: 205628 - protein, 39 aa, Artificial Sequence
  Description of Artificial Sequence: Synthetic polypeptide
CDAEIRTTNPVATEQYGQCVCSNWGEDHDQENFGSDTQS

SEQ ID NO: 205629 - protein, 39 aa, Artificial Sequence
  Description of Artificial Sequence: Synthetic polypeptide
DEAEISTTNPVATEQYGQCVCSNWGEDHNAENFISDTQE

SEQ ID NO: 205630 - protein, 39 aa, Artificial Sequence
  Description of Artificial Sequence: Synthetic polypeptide
AEMEIRTTNPVATEGYGQCVCSNWGEDHNEENFNSENQS

SEQ ID NO: 205631 - protein, 36 aa, Artificial Sequence
  Description of Artificial Sequence: Synthetic polypeptide
NESEIATTNPVAYEAWGVVWPGPNNENDSGIQNGES

SEQ ID NO: 205632 - protein, 39 aa, Artificial Sequence
  Description of Artificial Sequence: Synthetic polypeptide
AEACISTTNPVATEQYGQCVCSTWGEDHNAEYFNSENQS

SEQ ID NO: 205633 - protein, 38 aa, Artificial Sequence
  Description of Artificial Sequence: Synthetic polypeptide
AEACISTTNPVATEQYGQCVCSNWGEHNAENFNSDTQG

SEQ ID NO: 205634 - protein, 35 aa, Artificial Sequence
  Description of Artificial Sequence: Synthetic polypeptide
DENEIATTNPIATECWGATTWANAEDWAEPKGPYI

SEQ ID NO: 205635 - protein, 38 aa, Artificial Sequence
  Description of Artificial Sequence: Synthetic polypeptide
DDEEISTTNPVAYEGYGCVCSNWEEDHNAEHFNSENQA

SEQ ID NO: 205636 - protein, 39 aa, Artificial Sequence
  Description of Artificial Sequence: Synthetic polypeptide
DEDEIRTTNPCATEAYGVVATTNANANETGTEEGSVYIT

SEQ ID NO: 205637 - protein, 38 aa, Artificial Sequence
  Description of Artificial Sequence: Synthetic polypeptide
SAQEIATTNPVAYEQWGSNCAATTEGLPEASGNENMRD

SEQ ID NO: 205638 - protein, 39 aa, Artificial Sequence
  Description of Artificial Sequence: Synthetic polypeptide
DEDEIRTTNPCATEAYGVVATTNANANETGTEEGVTQIS

SEQ ID NO: 205639 - protein, 39 aa, Artificial Sequence
  Description of Artificial Sequence: Synthetic polypeptide
DEAEISTTNPVAYEQYGQCVCSNWGEDDNAENFNSDNQA

SEQ ID NO: 205640 - protein, 38 aa, Artificial Sequence
  Description of Artificial Sequence: Synthetic polypeptide
ADAEISTTNPVATEQYGQCVCSNWGEDNAENFNSDTQS

SEQ ID NO: 205641 - protein, 38 aa, Artificial Sequence
  Description of Artificial Sequence: Synthetic polypeptide
AEECIATTNPVATEQYGQCYCPNWGEDNQEHFNSETQA

SEQ ID NO: 205642 - protein, 35 aa, Artificial Sequence
  Description of Artificial Sequence: Synthetic polypeptide
DESEIRGTNPIATECWGATTWANAEDWAEPKGPYI

SEQ ID NO: 205643 - protein, 39 aa, Artificial Sequence
  Description of Artificial Sequence: Synthetic polypeptide
AEMEIATTNPVATEGYGQCVCSNWGEGHNAEHFGSENQS

SEQ ID NO: 205644 - protein, 38 aa, Artificial Sequence
  Description of Artificial Sequence: Synthetic polypeptide
DEEVIACTNPVATEQWGSACAAINPPEEAGAHQDNDAP

SEQ ID NO: 205645 - protein, 38 aa, Artificial Sequence
  Description of Artificial Sequence: Synthetic polypeptide
DEMCIRTTNPVATEGYGCTCSNWNEDHNAENFNSDTQA

SEQ ID NO: 205646 - protein, 38 aa, Artificial Sequence
  Description of Artificial Sequence: Synthetic polypeptide
DDEEISTTNPVATEGYGCVCGNWGEDHNAENFNSDTQP

SEQ ID NO: 205647 - protein, 37 aa, Artificial Sequence
  Description of Artificial Sequence: Synthetic polypeptide
AENEIACTNPVATEGYGQCSCSWMEHNAEYFGSDTQS

SEQ ID NO: 205648 - protein, 37 aa, Artificial Sequence
  Description of Artificial Sequence: Synthetic polypeptide
CEEEIACTNPVAYEQWGCTACAGANGLQEDAGEGEMW

SEQ ID NO: 205649 - protein, 37 aa, Artificial Sequence
  Description of Artificial Sequence: Synthetic polypeptide
AEAEIATTNPVATEGYGCVCSNWGEDDNQHFISETQA

SEQ ID NO: 205650 - protein, 36 aa, Artificial Sequence
  Description of Artificial Sequence: Synthetic polypeptide
DEMAIGTTNPVATEQYGALCTATDGSPEEFETSDKQ

SEQ ID NO: 205651 - protein, 39 aa, Artificial Sequence
  Description of Artificial Sequence: Synthetic polypeptide
SEECISTTNPVATEQYGQCVCSNSGEDHNIEHFNSDTQS

SEQ ID NO: 205652 - protein, 39 aa, Artificial Sequence
  Description of Artificial Sequence: Synthetic polypeptide
SEECISTTNPVATEQYGQCVCSNWGEDHNAENFISDNQS

SEQ ID NO: 205653 - protein, 39 aa, Artificial Sequence
  Description of Artificial Sequence: Synthetic polypeptide
SEECISTTNPVATEQYGQCVCGNWGELHNAENFNSDNQS

SEQ ID NO: 205654 - protein, 35 aa, Artificial Sequence
  Description of Artificial Sequence: Synthetic polypeptide
DDSEVASTNPVSTEGYGCVCFNWEDIQENFGSQQM

SEQ ID NO: 205655 - protein, 37 aa, Artificial Sequence
  Description of Artificial Sequence: Synthetic polypeptide
CEAEIACTNPVATEQWGTCMFATNGQNPETLENGEEA

SEQ ID NO: 205656 - protein, 37 aa, Artificial Sequence
  Description of Artificial Sequence: Synthetic polypeptide
AEAEIATTNPVATEGYGCVCSNWGEDDNAEHFISEQA

SEQ ID NO: 205657 - protein, 36 aa, Artificial Sequence
  Description of Artificial Sequence: Synthetic polypeptide
DEQEIACTNPVAYEQWGCTAGNNGLTTATPDGKMTY

SEQ ID NO: 205658 - protein, 36 aa, Artificial Sequence
  Description of Artificial Sequence: Synthetic polypeptide
AEAEIACTNPVGTEGYGVSCGSEDHNQEHFGSDTQA

SEQ ID NO: 205659 - protein, 38 aa, Artificial Sequence
  Description of Artificial Sequence: Synthetic polypeptide
SEECISTTNPVATEGYGQCVCSNWGEDNAEFFGSDTQS

SEQ ID NO: 205660 - protein, 38 aa, Artificial Sequence
  Description of Artificial Sequence: Synthetic polypeptide
CDEAISTTNPVATEQYGCVCSNWGEDHNAENFNSDNQM

SEQ ID NO: 205661 - protein, 36 aa, Artificial Sequence
  Description of Artificial Sequence: Synthetic polypeptide
AEAEIACTNPVGTEGYGQVSCGSEHNAEHFGSDTQA

SEQ ID NO: 205662 - protein, 36 aa, Artificial Sequence
  Description of Artificial Sequence: Synthetic polypeptide
AEAEIACTNPVGTEGYGCSCQTSGEDNQHFGSDTQA

SEQ ID NO: 205663 - protein, 38 aa, Artificial Sequence
  Description of Artificial Sequence: Synthetic polypeptide
DESEIRTTNPVATEGWGQCVCSWGEDENAEYFISDTQS

SEQ ID NO: 205664 - protein, 38 aa, Artificial Sequence
  Description of Artificial Sequence: Synthetic polypeptide
AEECIATTNPVATEQYGCYCPTWGEDDNAEHFNSETQA

SEQ ID NO: 205665 - protein, 37 aa, Artificial Sequence
  Description of Artificial Sequence: Synthetic polypeptide
CEEEIACTNPVAYEQWGHCFVATGELADITNSDEDAM

SEQ ID NO: 205666 - protein, 39 aa, Artificial Sequence
  Description of Artificial Sequence: Synthetic polypeptide
DDECISTTNPVATEQYGQCVCSNWGEDDNAENFNSDNQN

SEQ ID NO: 205667 - protein, 38 aa, Artificial Sequence
  Description of Artificial Sequence: Synthetic polypeptide
DEEEIATTNPVAYYAPWGPSACTAANGDAMQATNDQHQ

SEQ ID NO: 205668 - protein, 37 aa, Artificial Sequence
  Description of Artificial Sequence: Synthetic polypeptide
CEEEIACTNPVAYEQWGHCFVATGEHADIGNSVEDAM

SEQ ID NO: 205669 - protein, 39 aa, Artificial Sequence
  Description of Artificial Sequence: Synthetic polypeptide
DESEIRTTNPVATEGWGQCVCSNWMEDENQEYFGSDTQS

SEQ ID NO: 205670 - protein, 38 aa, Artificial Sequence
  Description of Artificial Sequence: Synthetic polypeptide
SECAEIATTNPVAYEAWGVCVQWEPNNDTQRPGGGGRM

SEQ ID NO: 205671 - protein, 37 aa, Artificial Sequence
  Description of Artificial Sequence: Synthetic polypeptide
CDEAISTTNPVATEGYGCVCSNWEEHNAESFNSDTQA

SEQ ID NO: 205672 - protein, 37 aa, Artificial Sequence
  Description of Artificial Sequence: Synthetic polypeptide
SEAEIGCTNPVATEQYGCVCENWGEHNAEHFNSDTQA

SEQ ID NO: 205673 - protein, 39 aa, Artificial Sequence
  Description of Artificial Sequence: Synthetic polypeptide
ADEAIRTTNPVATEQYGQCVCSNWMEDHNAENFNSENQS

SEQ ID NO: 205674 - protein, 38 aa, Artificial Sequence
  Description of Artificial Sequence: Synthetic polypeptide
AENEIACTNPVATEGYGQCSCSTWGEDNQEYFGSDTQS

SEQ ID NO: 205675 - protein, 38 aa, Artificial Sequence
  Description of Artificial Sequence: Synthetic polypeptide
DDEEISTTNPVAYEGYGQCVCSNWGEHNAENFNSQTQA

SEQ ID NO: 205676 - protein, 39 aa, Artificial Sequence
  Description of Artificial Sequence: Synthetic polypeptide
DEEEISCTNPVAYEQYGQCVCSMWGEDDNQEGFGSDTQA

SEQ ID NO: 205677 - protein, 38 aa, Artificial Sequence
  Description of Artificial Sequence: Synthetic polypeptide
DEEEISCTNPVAYEQYGQCVCGNWGEHNAENFNSETQP

SEQ ID NO: 205678 - protein, 38 aa, Artificial Sequence
  Description of Artificial Sequence: Synthetic polypeptide
CDAEISTTNPVATEQYGCVCSNWGEDHNQENFGSDFQS

SEQ ID NO: 205679 - protein, 39 aa, Artificial Sequence
  Description of Artificial Sequence: Synthetic polypeptide
DDECISTTNPVAYEQYGQCVCSNWGEDTNAENFNSDTQA

SEQ ID NO: 205680 - protein, 37 aa, Artificial Sequence
  Description of Artificial Sequence: Synthetic polypeptide
SAQEIATTNPVATEQYGCVAPGEGVHGNESGEEDGMV

SEQ ID NO: 205681 - protein, 39 aa, Artificial Sequence
  Description of Artificial Sequence: Synthetic polypeptide
DEEEISCTNPVAYEQYGQCVCSNWEEDHNAENFNSDTQG

SEQ ID NO: 205682 - protein, 39 aa, Artificial Sequence
  Description of Artificial Sequence: Synthetic polypeptide
SEECISTTNPVATEQYGQCVCSNWGEDHNAESFNSDTQS

SEQ ID NO: 205683 - protein, 40 aa, Artificial Sequence
  Description of Artificial Sequence: Synthetic polypeptide
CEAEIKTTNPVATEQYGDVVVGSGQEDQEEQGNEGEGNGV

SEQ ID NO: 205684 - protein, 38 aa, Artificial Sequence
  Description of Artificial Sequence: Synthetic polypeptide
DDEEISTTNPVAYEGYGQCVCSNWGEHNAEGFNSETQG

SEQ ID NO: 205685 - protein, 38 aa, Artificial Sequence
  Description of Artificial Sequence: Synthetic polypeptide
DEMEIRTTNPVATEGWGQCVCSNWGEENAEYFISDTQS

SEQ ID NO: 205686 - protein, 37 aa, Artificial Sequence
  Description of Artificial Sequence: Synthetic polypeptide
TRSAEIVRTTNPVAYEPYGNICALGNEDAQHYNGNEN

SEQ ID NO: 205687 - protein, 35 aa, Artificial Sequence
  Description of Artificial Sequence: Synthetic polypeptide
DENEIATTNPCLYEPYGTTSAMEWDQQQQNGDVHK

SEQ ID NO: 205688 - protein, 39 aa, Artificial Sequence
  Description of Artificial Sequence: Synthetic polypeptide
DEAEISTTNPVAYEQYGQCVCSNWGEDDNAENFNSDTQS

SEQ ID NO: 205689 - protein, 38 aa, Artificial Sequence
  Description of Artificial Sequence: Synthetic polypeptide
DDEEISTTNPVAYEGYGQCVCSNWGEHNAENFISDNQA

SEQ ID NO: 205690 - protein, 37 aa, Artificial Sequence
  Description of Artificial Sequence: Synthetic polypeptide
AENEIACTNPVATEGYGQCSCSWGEDNQEYFNSDTQA

SEQ ID NO: 205691 - protein, 39 aa, Artificial Sequence
  Description of Artificial Sequence: Synthetic polypeptide
DDECIRTTNPVATEQYGQCVCSNWGEDHNAENFISDTQA

SEQ ID NO: 205692 - protein, 38 aa, Artificial Sequence
  Description of Artificial Sequence: Synthetic polypeptide
DDEEISTTNPVAYEGYGQCVCSNWGEHNQENFNSDNQG

SEQ ID NO: 205693 - protein, 39 aa, Artificial Sequence
  Description of Artificial Sequence: Synthetic polypeptide
SEECISTTNPVATEQYGQCVCSNWGEDHNAENFNSDNQM

SEQ ID NO: 205694 - protein, 37 aa, Artificial Sequence
  Description of Artificial Sequence: Synthetic polypeptide
DEEQIATTNPVATEQWGCWNAAPNDDEATMPMDEGAH

SEQ ID NO: 205695 - protein, 39 aa, Artificial Sequence
  Description of Artificial Sequence: Synthetic polypeptide
DEEEISCTNPVAYEQYGQCVCSNWGEDHNAEGFNSDTQG

SEQ ID NO: 205696 - protein, 38 aa, Artificial Sequence
  Description of Artificial Sequence: Synthetic polypeptide
CDAEISTTNPVATEQYGQCVCSNWGEDNAENFNSDTQA

SEQ ID NO: 205697 - protein, 37 aa, Artificial Sequence
  Description of Artificial Sequence: Synthetic polypeptide
CEEEIACTNPVAYEQWGTCFPATGELADIGNSDESAM

SEQ ID NO: 205698 - protein, 36 aa, Artificial Sequence
  Description of Artificial Sequence: Synthetic polypeptide
CEEEIACTNPVATESYGTACPPVDLVQTAADIQAHE

SEQ ID NO: 205699 - protein, 39 aa, Artificial Sequence
  Description of Artificial Sequence: Synthetic polypeptide
DDEEISTTNPVATEEYGQCVCSNWGEDHNAEYFNSDNQS

SEQ ID NO: 205700 - protein, 39 aa, Artificial Sequence
  Description of Artificial Sequence: Synthetic polypeptide
DEEEISCTNPVAYEQYGQCVCSNWGEDDNQEYFGSDTQS

SEQ ID NO: 205701 - protein, 37 aa, Artificial Sequence
  Description of Artificial Sequence: Synthetic polypeptide
DDEEISTTNPVAYEQWGCVTSNWGEHNAENFISDTAS

SEQ ID NO: 205702 - protein, 39 aa, Artificial Sequence
  Description of Artificial Sequence: Synthetic polypeptide
SEECISTTNPVATEQYGQCVCSNWGEDHNAENFNSDTQQ

SEQ ID NO: 205703 - protein, 39 aa, Artificial Sequence
  Description of Artificial Sequence: Synthetic polypeptide
DEAEISTTNPVAYEQYGQCVCSNWGEDDNAENFNSDNQQ

SEQ ID NO: 205704 - protein, 38 aa, Artificial Sequence
  Description of Artificial Sequence: Synthetic polypeptide
AEMEIATTNPVATEQYGCYCPNWGEGDNQEHFNSETQA

SEQ ID NO: 205705 - protein, 38 aa, Artificial Sequence
  Description of Artificial Sequence: Synthetic polypeptide
DEMCIGTTNPVATEQWGQCVCSNWEDDNQEYFGSDTQA

SEQ ID NO: 205706 - protein, 39 aa, Artificial Sequence
  Description of Artificial Sequence: Synthetic polypeptide
DEEEISCTNPVAYEQYGQCVCSNWGEAHNAENFNSDNQA

SEQ ID NO: 205707 - protein, 39 aa, Artificial Sequence
  Description of Artificial Sequence: Synthetic polypeptide
DEDEIATTNPVATEQWGGCTVFAGNGGGGAEAPGQDQRF

SEQ ID NO: 205708 - protein, 38 aa, Artificial Sequence
  Description of Artificial Sequence: Synthetic polypeptide
AEECISTTNPVAYEQYGQCVTSTWGADNAEYFISDPQS

SEQ ID NO: 205709 - protein, 37 aa, Artificial Sequence
  Description of Artificial Sequence: Synthetic polypeptide
AEAEIATTNPVATEQYGCFCQNWGEDNQEHFSSETQS

SEQ ID NO: 205710 - protein, 39 aa, Artificial Sequence
  Description of Artificial Sequence: Synthetic polypeptide
ADEEISTTNPVAYEQYGQCVCSTWGEDDNAENFNSDTQS

SEQ ID NO: 205711 - protein, 39 aa, Artificial Sequence
  Description of Artificial Sequence: Synthetic polypeptide
DDECIRTTNPVAYEQYGQCVCSNWGEDDNAEYFNSDNQA

SEQ ID NO: 205712 - protein, 36 aa, Artificial Sequence
  Description of Artificial Sequence: Synthetic polypeptide
DEMCISTTNPLAYEQFGCVCSWGEHNAESFNSDTQA

SEQ ID NO: 205713 - protein, 36 aa, Artificial Sequence
  Description of Artificial Sequence: Synthetic polypeptide
SDNEIATTNPVATEGYGCVCSWGEHNAEHFISETQA

SEQ ID NO: 205714 - protein, 39 aa, Artificial Sequence
  Description of Artificial Sequence: Synthetic polypeptide
QEQEIATTNPVATEQWGNISFSAPDDTLREPHEGQEDTR

SEQ ID NO: 205715 - protein, 36 aa, Artificial Sequence
  Description of Artificial Sequence: Synthetic polypeptide
DEAEIATTNPIATECWGATYYANENDQDEKKGKEIQ

SEQ ID NO: 205716 - protein, 36 aa, Artificial Sequence
  Description of Artificial Sequence: Synthetic polypeptide
DEAEIATTNPIATECWGATYYANENDQHEKTGKTMG

SEQ ID NO: 205717 - protein, 39 aa, Artificial Sequence
  Description of Artificial Sequence: Synthetic polypeptide
AEECISTTNPVATEQYGQCAVCSWGEPHNAENFNSEFQS

SEQ ID NO: 205718 - protein, 38 aa, Artificial Sequence
  Description of Artificial Sequence: Synthetic polypeptide
DEEEIATTNPVATEMWGTNCSAAADAGMTMHQDDTLAQ

SEQ ID NO: 205719 - protein, 39 aa, Artificial Sequence
  Description of Artificial Sequence: Synthetic polypeptide
DEAEISTTNPVAYEQYGQCVCSNSGEAHNAENFNSDTQA

SEQ ID NO: 205720 - protein, 39 aa, Artificial Sequence
  Description of Artificial Sequence: Synthetic polypeptide
AEAEIRTTNPVAYEQYGQCVCSNWGEDDNEENFNSETQA

SEQ ID NO: 205721 - protein, 39 aa, Artificial Sequence
  Description of Artificial Sequence: Synthetic polypeptide
AEAEIRTTNPVAYEQYGQCVCSNWGEDHNAENFNSDTQS

SEQ ID NO: 205722 - protein, 35 aa, Artificial Sequence
  Description of Artificial Sequence: Synthetic polypeptide
VEDEIACTNPVATEQWGGCVAAQAPGATMMPYNTD

SEQ ID NO: 205723 - protein, 36 aa, Artificial Sequence
  Description of Artificial Sequence: Synthetic polypeptide
DSSEVASTNPVSYEGYGNVVACNGTISQILVGGQNR

SEQ ID NO: 205724 - protein, 35 aa, Artificial Sequence
  Description of Artificial Sequence: Synthetic polypeptide
DDSEVASTNPVSYEGYGNTVACNTEASQSSTGGQR

SEQ ID NO: 205725 - protein, 39 aa, Artificial Sequence
  Description of Artificial Sequence: Synthetic polypeptide
DEAEISTTNPVAYEQYGQCVCSNWGEDDNAESFNSETQP

SEQ ID NO: 205726 - protein, 39 aa, Artificial Sequence
  Description of Artificial Sequence: Synthetic polypeptide
DEEEISCTNPVATEQYGQCVCGNSGEDHNAENFISDTQS

SEQ ID NO: 205727 - protein, 39 aa, Artificial Sequence
  Description of Artificial Sequence: Synthetic polypeptide
DEEEISCTNPVATEQYGQCVCGNWGEDHNAEYFNSENQA

SEQ ID NO: 205728 - protein, 39 aa, Artificial Sequence
  Description of Artificial Sequence: Synthetic polypeptide
DDECISTTNPVATEQYGQCVCGNSGEDHNQENFGSDTQS

SEQ ID NO: 205729 - protein, 40 aa, Artificial Sequence
  Description of Artificial Sequence: Synthetic polypeptide
DEAEIRTTNPVATEQYGTFIYEGTENPTDSSMVATEPQNF

SEQ ID NO: 205730 - protein, 38 aa, Artificial Sequence
  Description of Artificial Sequence: Synthetic polypeptide
DEEEIACTNPVAYEPWGSACSVANPHLNNEAPGGEAAH

SEQ ID NO: 205731 - protein, 38 aa, Artificial Sequence
  Description of Artificial Sequence: Synthetic polypeptide
CEAEISTTNPVATEAYGQCVCSNWGEHNAENFNSDNQS

SEQ ID NO: 205732 - protein, 39 aa, Artificial Sequence
  Description of Artificial Sequence: Synthetic polypeptide
DEMEISTTNPVAYEQYGQCVCSNSGEDHNAENFNSDTQS

SEQ ID NO: 205733 - protein, 37 aa, Artificial Sequence
  Description of Artificial Sequence: Synthetic polypeptide
DEHCIRTTNPVAYEPWGVCQCEILDVMDRTNRKGEDK

SEQ ID NO: 205734 - protein, 40 aa, Artificial Sequence
  Description of Artificial Sequence: Synthetic polypeptide
DEEEISCTNPVATEQYGQCAVCSNWGEDHNAENFNSDTQS

SEQ ID NO: 205735 - protein, 36 aa, Artificial Sequence
  Description of Artificial Sequence: Synthetic polypeptide
DENEIATTNPTAYEQWGATYYSNEIEVMNQIEMDYR

SEQ ID NO: 205736 - protein, 39 aa, Artificial Sequence
  Description of Artificial Sequence: Synthetic polypeptide
DEAEISTTNPVAYEQYGQCVCSMWGEDDNEEYFNSDNQS

SEQ ID NO: 205737 - protein, 36 aa, Artificial Sequence
  Description of Artificial Sequence: Synthetic polypeptide
DSSEVASTNPVSYEGYGNVVACNEISQSQVGGQNPR

SEQ ID NO: 205738 - protein, 36 aa, Artificial Sequence
  Description of Artificial Sequence: Synthetic polypeptide
DSSEVASTNPVSYEGYGNVVACNETISQSNVGGQNR

SEQ ID NO: 205739 - protein, 39 aa, Artificial Sequence
  Description of Artificial Sequence: Synthetic polypeptide
ADEAISTTNPVATEQYGQCVCSNWGEDHNAEHFGSENQS

SEQ ID NO: 205740 - protein, 39 aa, Artificial Sequence
  Description of Artificial Sequence: Synthetic polypeptide
DEAEISTTNPVAYEQYGQCVCSMWMEDHNAEYFGSQTQA

SEQ ID NO: 205741 - protein, 39 aa, Artificial Sequence
  Description of Artificial Sequence: Synthetic polypeptide
DEEEISCTNPVATEQYGQCVCQNWGEDHNAENFNSDTQN

SEQ ID NO: 205742 - protein, 39 aa, Artificial Sequence
  Description of Artificial Sequence: Synthetic polypeptide
CEAEISTTNPVATEEYGQCVCSNWGEDHNAENFGSDNQA

SEQ ID NO: 205743 - protein, 39 aa, Artificial Sequence
  Description of Artificial Sequence: Synthetic polypeptide
DDEEIRTTNPVAYEGYGQCVCSNWGEDHNAENFISENQS

SEQ ID NO: 205744 - protein, 39 aa, Artificial Sequence
  Description of Artificial Sequence: Synthetic polypeptide
DDEEIRTTNPVAYEGYGQCVCSNWGEDHNAENFNSDTQL

SEQ ID NO: 205745 - protein, 39 aa, Artificial Sequence
  Description of Artificial Sequence: Synthetic polypeptide
DDEEIRTTNPVAYEGYGQCVCSNWGEDHNAENFNSDTQS

SEQ ID NO: 205746 - protein, 38 aa, Artificial Sequence
  Description of Artificial Sequence: Synthetic polypeptide
SEEEIRCTNPCATEQYGQCVCSWGEDDNAENFSSDTQS

SEQ ID NO: 205747 - protein, 36 aa, Artificial Sequence
  Description of Artificial Sequence: Synthetic polypeptide
DSSEVASTNPVSYEGYGNVVACQTISQSLVGGQNRE

SEQ ID NO: 205748 - protein, 37 aa, Artificial Sequence
  Description of Artificial Sequence: Synthetic polypeptide
DENEIATTNPVATAQWGCVAGEHGVEEMNAALMDNHM

SEQ ID NO: 205749 - protein, 37 aa, Artificial Sequence
  Description of Artificial Sequence: Synthetic polypeptide
DEAEISTTNPVAYEQYGCICSNWGEHNAENFISDTQA

SEQ ID NO: 205750 - protein, 38 aa, Artificial Sequence
  Description of Artificial Sequence: Synthetic polypeptide
AEEEISTTNPVAYEQYGCVCGNWGEDHNAENFNSDTQA

SEQ ID NO: 205751 - protein, 37 aa, Artificial Sequence
  Description of Artificial Sequence: Synthetic polypeptide
DEMEIRTTNPIATEAWGCQTCQNAEDDAENSGSDNQS

SEQ ID NO: 205752 - protein, 37 aa, Artificial Sequence
  Description of Artificial Sequence: Synthetic polypeptide
VEDEIACTNPVATEQWGCVNANNPALGEAHQMDMEAE

SEQ ID NO: 205753 - protein, 38 aa, Artificial Sequence
  Description of Artificial Sequence: Synthetic polypeptide
NEREIRTTNPVATEQYGQCVCQWGEDHNAENFISDTQS

SEQ ID NO: 205754 - protein, 39 aa, Artificial Sequence
  Description of Artificial Sequence: Synthetic polypeptide
DEAEISTTNPVAYEQYGQCVCSNWGEDDNAEYFNSDTQA

SEQ ID NO: 205755 - protein, 39 aa, Artificial Sequence
  Description of Artificial Sequence: Synthetic polypeptide
SEEEIACTNPVATEQWGCNVVTAGDGHGEMTADQNGDNF

SEQ ID NO: 205756 - protein, 37 aa, Artificial Sequence
  Description of Artificial Sequence: Synthetic polypeptide
VEDEIRTTNPVATEQWGTCCAGAGAHPGDLHPDDSNW

SEQ ID NO: 205757 - protein, 39 aa, Artificial Sequence
  Description of Artificial Sequence: Synthetic polypeptide
DEAEISTTNPVAYEQYGQCVCSNWGEDHNAEHFNSDNQN

SEQ ID NO: 205758 - protein, 39 aa, Artificial Sequence
  Description of Artificial Sequence: Synthetic polypeptide
DEAEISTTNPVAYEQYGQCVCSNWGEDHNAENFGSDTQS

SEQ ID NO: 205759 - protein, 39 aa, Artificial Sequence
  Description of Artificial Sequence: Synthetic polypeptide
DDEEIRTTNPVAYEQYGQCVCSNWEEDHNAENFISDTQS

SEQ ID NO: 205760 - protein, 41 aa, Artificial Sequence
  Description of Artificial Sequence: Synthetic polypeptide
ALEIEGIWRSITNRLVWALTEMQYGDSGALTNCGQAAGNRH

SEQ ID NO: 205761 - protein, 39 aa, Artificial Sequence
  Description of Artificial Sequence: Synthetic polypeptide
DEMCIATTNPVAYEQYGQCVCSNWGEDDNAEHFGSENQA

SEQ ID NO: 205762 - protein, 39 aa, Artificial Sequence
  Description of Artificial Sequence: Synthetic polypeptide
DDEEISTTNPVATEQYGQCVCSNWGEDHNAEGFISDTQS

SEQ ID NO: 205763 - protein, 38 aa, Artificial Sequence
  Description of Artificial Sequence: Synthetic polypeptide
VEDEIACTNPVATEQWGCVTAIANAQDTAAATGDDNEM

SEQ ID NO: 205764 - protein, 36 aa, Artificial Sequence
  Description of Artificial Sequence: Synthetic polypeptide
DEAEIACTNPVAYEQWGCVAGEALALNGAPLGEAPN

SEQ ID NO: 205765 - protein, 38 aa, Artificial Sequence
  Description of Artificial Sequence: Synthetic polypeptide
SEEEIRCTNPCATEQYGQCVCSNWMEHNAENFISDTQS

SEQ ID NO: 205766 - protein, 39 aa, Artificial Sequence
  Description of Artificial Sequence: Synthetic polypeptide
QEEEIRCTNCVATEQYGVVVVGVNQQNDEQMEQGIGEGQ

SEQ ID NO: 205767 - protein, 39 aa, Artificial Sequence
  Description of Artificial Sequence: Synthetic polypeptide
DDEEISTTNPVATEQYGQCVCSNWGEDHNAENFTSDTQA

SEQ ID NO: 205768 - protein, 39 aa, Artificial Sequence
  Description of Artificial Sequence: Synthetic polypeptide
DDEEIRTTNPVAYEQWGQCVTSNWGEDHNAENFGSDTAS

SEQ ID NO: 205769 - protein, 34 aa, Artificial Sequence
  Description of Artificial Sequence: Synthetic polypeptide
DENEIACTNPIATECWGATTWANAEDWAEPGPYI

SEQ ID NO: 205770 - protein, 40 aa, Artificial Sequence
  Description of Artificial Sequence: Synthetic polypeptide
AEAEIRTTNPVATEQYGQCQVCSNWGEDHNAENFNSETQS

SEQ ID NO: 205771 - protein, 37 aa, Artificial Sequence
  Description of Artificial Sequence: Synthetic polypeptide
SDNEIATTNPVATEGYGCVCSWGEDDNAEHFISENQA

SEQ ID NO: 205772 - protein, 38 aa, Artificial Sequence
  Description of Artificial Sequence: Synthetic polypeptide
ADREISTTNPVATEQYGQCVCSNWGEHNAENFNSETQS

SEQ ID NO: 205773 - protein, 39 aa, Artificial Sequence
  Description of Artificial Sequence: Synthetic polypeptide
DDECIRTTNPVGTEQWGQCVCSNWGEDHNAENFGSVNQS

SEQ ID NO: 205774 - protein, 39 aa, Artificial Sequence
  Description of Artificial Sequence: Synthetic polypeptide
AEEEISTTNPVAYEGYGQCVCSTWGEDHNIENFNSDTQN

SEQ ID NO: 205775 - protein, 39 aa, Artificial Sequence
  Description of Artificial Sequence: Synthetic polypeptide
DDEEISTTNPVATEQYGQCVCSNWGEDHNAENFISDTQS

SEQ ID NO: 205776 - protein, 35 aa, Artificial Sequence
  Description of Artificial Sequence: Synthetic polypeptide
DSSEVASTNPVSYEGYGNVVACNTISQSQVSGQNA

SEQ ID NO: 205777 - protein, 38 aa, Artificial Sequence
  Description of Artificial Sequence: Synthetic polypeptide
SEEEIRCTNPCATEQYGQCVCSWGEDDNAEHFISDTQA

SEQ ID NO: 205778 - protein, 38 aa, Artificial Sequence
  Description of Artificial Sequence: Synthetic polypeptide
AEEEISTTNPVAYEGYGQCVCSNWGEHNAENFNSDTQA

SEQ ID NO: 205779 - protein, 39 aa, Artificial Sequence
  Description of Artificial Sequence: Synthetic polypeptide
DEMEISTTNPVAYEQYGQCVCSDWMEDHNAEYFNSQTQA

SEQ ID NO: 205780 - protein, 39 aa, Artificial Sequence
  Description of Artificial Sequence: Synthetic polypeptide
DEAEIRTTNPVATEGYGICVCSNWEEDDNQENFISDTQS

SEQ ID NO: 205781 - protein, 39 aa, Artificial Sequence
  Description of Artificial Sequence: Synthetic polypeptide
CEEEISTTNPVATEQYGQCVCSNWGEDPNAENFISDTQA

SEQ ID NO: 205782 - protein, 38 aa, Artificial Sequence
  Description of Artificial Sequence: Synthetic polypeptide
DEEEISCTNPVAYEGYGQCVCSNWEEHNIENFNSDPQA

SEQ ID NO: 205783 - protein, 38 aa, Artificial Sequence
  Description of Artificial Sequence: Synthetic polypeptide
DDECISTTNPVATEQYGQCVCSMWGEHNQENFISDTQA

SEQ ID NO: 205784 - protein, 39 aa, Artificial Sequence
  Description of Artificial Sequence: Synthetic polypeptide
SEAEISTTNPVAYEQYGQCVCSTWGEDHNQENFNSDTQA

SEQ ID NO: 205785 - protein, 35 aa, Artificial Sequence
  Description of Artificial Sequence: Synthetic polypeptide
AETEIRTTNPIATECWGETTWANAEHWAEPKGPYI

SEQ ID NO: 205786 - protein, 39 aa, Artificial Sequence
  Description of Artificial Sequence: Synthetic polypeptide
DEECIRTTNPVAYEQYGQCVCGNWEEDHNAENFNSDNQL

SEQ ID NO: 205787 - protein, 39 aa, Artificial Sequence
  Description of Artificial Sequence: Synthetic polypeptide
DDEEISTTNPVATEYYGQCVCSNSGEDHNAEHFNSDTQS

SEQ ID NO: 205788 - protein, 36 aa, Artificial Sequence
  Description of Artificial Sequence: Synthetic polypeptide
NEMVIGTTNPVATEQYGCLCQAWQGSVVEFETMDKQ

SEQ ID NO: 205789 - protein, 36 aa, Artificial Sequence
  Description of Artificial Sequence: Synthetic polypeptide
NEMVIGTTNPVATEQYGCLCQAWWGSPVEFETQDKQ

SEQ ID NO: 205790 - protein, 38 aa, Artificial Sequence
  Description of Artificial Sequence: Synthetic polypeptide
SEAEISTTNPVAYEQYGQCVCSNWGEHNAENFNSDTQS

SEQ ID NO: 205791 - protein, 39 aa, Artificial Sequence
  Description of Artificial Sequence: Synthetic polypeptide
DDECISTTNPVATEQYGQCVCSMWGEDHNAENFNSDTQA

SEQ ID NO: 205792 - protein, 35 aa, Artificial Sequence
  Description of Artificial Sequence: Synthetic polypeptide
DDSEVASTNPVSTEGYGCVCANSEHNQEHFGSQQS

SEQ ID NO: 205793 - protein, 39 aa, Artificial Sequence
  Description of Artificial Sequence: Synthetic polypeptide
AEAAISTTNPVATEQYGQCVCSNWEEDHNAENFQSDNQA

SEQ ID NO: 205794 - protein, 37 aa, Artificial Sequence
  Description of Artificial Sequence: Synthetic polypeptide
VEDEIACTNPVATEQWGSVAIEPPGHDNGAGNPEGTN

SEQ ID NO: 205795 - protein, 38 aa, Artificial Sequence
  Description of Artificial Sequence: Synthetic polypeptide
EIEEIATTNPVAYEQWGVVCYQVTTNEHNQDRDDTSGE

SEQ ID NO: 205796 - protein, 39 aa, Artificial Sequence
  Description of Artificial Sequence: Synthetic polypeptide
SEAEISTTNPVAYEQYGQCVCSTWGEDHNAENFNSDFQS

SEQ ID NO: 205797 - protein, 39 aa, Artificial Sequence
  Description of Artificial Sequence: Synthetic polypeptide
AEAEISTTNPVAYEQYGQCVCSNWGEDHNAENFGSDNQA

SEQ ID NO: 205798 - protein, 39 aa, Artificial Sequence
  Description of Artificial Sequence: Synthetic polypeptide
DEECIRTTNPVAYEQYGQCVCSNWGEDDNAEFFISDTQA

SEQ ID NO: 205799 - protein, 38 aa, Artificial Sequence
  Description of Artificial Sequence: Synthetic polypeptide
DEAEISTTNPVCTEHYGQCVCSNWGEHNAENFGSDTQA

SEQ ID NO: 205800 - protein, 38 aa, Artificial Sequence
  Description of Artificial Sequence: Synthetic polypeptide
AEECISTTNPVATEGYGQCVCSNWGEHNAENFNSETQM

SEQ ID NO: 205801 - protein, 38 aa, Artificial Sequence
  Description of Artificial Sequence: Synthetic polypeptide
AEAEISTTNPVAYEQYGQCVCSMWGEHNAENFNSDTQA

SEQ ID NO: 205802 - protein, 36 aa, Artificial Sequence
  Description of Artificial Sequence: Synthetic polypeptide
NEMVIGTTNPVATEQYGCLCQAVCGSPVEFETMDKQ

SEQ ID NO: 205803 - protein, 36 aa, Artificial Sequence
  Description of Artificial Sequence: Synthetic polypeptide
NEMVIGTTNPVATEQYGCLCQAWDGSPVEFETNDKV

SEQ ID NO: 205804 - protein, 38 aa, Artificial Sequence
  Description of Artificial Sequence: Synthetic polypeptide
DEDEIATTNPVAYEQWGTNCAATAGELGPDSMGPNEHM

SEQ ID NO: 205805 - protein, 39 aa, Artificial Sequence
  Description of Artificial Sequence: Synthetic polypeptide
AEECISTTNPVATEGYGQCVCSTWGEDTNEENFNSDTQA

SEQ ID NO: 205806 - protein, 37 aa, Artificial Sequence
  Description of Artificial Sequence: Synthetic polypeptide
VEDEIACTNPVATEQWGSVVAGAGPAGFTEGGDNSDD

SEQ ID NO: 205807 - protein, 38 aa, Artificial Sequence
  Description of Artificial Sequence: Synthetic polypeptide
AEECISTTNPVATEQYGCVCGNWGEDHNAEFFNSENQA

SEQ ID NO: 205808 - protein, 38 aa, Artificial Sequence
  Description of Artificial Sequence: Synthetic polypeptide
AEAEIATTNPVATEQYGCSCPNWMEDDNAEHFNSETQA

SEQ ID NO: 205809 - protein, 39 aa, Artificial Sequence
  Description of Artificial Sequence: Synthetic polypeptide
CEAEIRTTNPVAYEQYGQCVCSNWGEDHNAENFNSDTQA

SEQ ID NO: 205810 - protein, 35 aa, Artificial Sequence
  Description of Artificial Sequence: Synthetic polypeptide
AETEIRTTNPIATECWGATTWANAEDWAEPKGPYL

SEQ ID NO: 205811 - protein, 38 aa, Artificial Sequence
  Description of Artificial Sequence: Synthetic polypeptide
AEAEISTTNPVATEGYGCVCSNWGEDHNAENFNSENQS

SEQ ID NO: 205812 - protein, 38 aa, Artificial Sequence
  Description of Artificial Sequence: Synthetic polypeptide
VEDEIACTNPVATEQWGTCVAAIANALTAAATGDGNEM

SEQ ID NO: 205813 - protein, 38 aa, Artificial Sequence
  Description of Artificial Sequence: Synthetic polypeptide
DEMEIRTTNPVATCHYGQCVCSNWGEHNAENFTSDTQA

SEQ ID NO: 205814 - protein, 38 aa, Artificial Sequence
  Description of Artificial Sequence: Synthetic polypeptide
SEEEIRCTNPCATEGYGQCVCSNWGEDNAEHFGSDTQS

SEQ ID NO: 205815 - protein, 38 aa, Artificial Sequence
  Description of Artificial Sequence: Synthetic polypeptide
ADEEISTTNPVAYEQYGQCVCSNWGEHNAEYFNSDTQP

SEQ ID NO: 205816 - protein, 38 aa, Artificial Sequence
  Description of Artificial Sequence: Synthetic polypeptide
DEEEISCTNPVAYEGYGCVCSNWGEDHNAENFNSETQA

SEQ ID NO: 205817 - protein, 34 aa, Artificial Sequence
  Description of Artificial Sequence: Synthetic polypeptide
DESEIATTNPIGTECWGATTWANADWAEPKGPYI

SEQ ID NO: 205818 - protein, 39 aa, Artificial Sequence
  Description of Artificial Sequence: Synthetic polypeptide
DEAEISTTNPVAYEQYGQCVCSDWGEDHNAENFNSDTQS

SEQ ID NO: 205819 - protein, 38 aa, Artificial Sequence
  Description of Artificial Sequence: Synthetic polypeptide
DDECISTTNPVATEQYGQCVCGNWGEHNEEGFGSDTQS

SEQ ID NO: 205820 - protein, 33 aa, Artificial Sequence
  Description of Artificial Sequence: Synthetic polypeptide
SDSEIACTNPCSYEQWGITCYCNDQQDHGDTSR

SEQ ID NO: 205821 - protein, 39 aa, Artificial Sequence
  Description of Artificial Sequence: Synthetic polypeptide
AEEEISTTNPVAYEGYGQCVCSNWGEDHNTEHFQSENQS

SEQ ID NO: 205822 - protein, 39 aa, Artificial Sequence
  Description of Artificial Sequence: Synthetic polypeptide
DEAEISTTNPVATEQYGQVVCSNWGEDDNAEYFPSDTQS

SEQ ID NO: 205823 - protein, 36 aa, Artificial Sequence
  Description of Artificial Sequence: Synthetic polypeptide
DSSEVASTNPVSYEGYGNTVACNTISQSQVGGQNRR

SEQ ID NO: 205824 - protein, 39 aa, Artificial Sequence
  Description of Artificial Sequence: Synthetic polypeptide
DEDEIATTNPVAYEQWGVSIICPAVADAGNDHQGDNMEI

SEQ ID NO: 205825 - protein, 36 aa, Artificial Sequence
  Description of Artificial Sequence: Synthetic polypeptide
DENEIATTNPTAYEQWGATYYSIEIEMNQREMDFYT

SEQ ID NO: 205826 - protein, 37 aa, Artificial Sequence
  Description of Artificial Sequence: Synthetic polypeptide
DEEEIACTNPVAYEQWGCCAAAPGNHGNAEGGIGNQN

SEQ ID NO: 205827 - protein, 37 aa, Artificial Sequence
  Description of Artificial Sequence: Synthetic polypeptide
AEEEIACTNPVAYEPQWGCNVAGSGELGTEDQMNKMH

SEQ ID NO: 205828 - protein, 36 aa, Artificial Sequence
  Description of Artificial Sequence: Synthetic polypeptide
NEMVIGTTNPVATEQYGELCQAWDGSPVENETMDKQ

SEQ ID NO: 205829 - protein, 37 aa, Artificial Sequence
  Description of Artificial Sequence: Synthetic polypeptide
DENEIATTNPTAYEQWGATYYSIEIEQMNQREMDIYR

SEQ ID NO: 205830 - protein, 38 aa, Artificial Sequence
  Description of Artificial Sequence: Synthetic polypeptide
CEAEISCTNPVATEQYGQCVCSWGEDHNQENFNSDTQA

SEQ ID NO: 205831 - protein, 38 aa, Artificial Sequence
  Description of Artificial Sequence: Synthetic polypeptide
CEEEIACTNPVATEQWGCPFAGTNGQNPETLENGEEAH

SEQ ID NO: 205832 - protein, 36 aa, Artificial Sequence
  Description of Artificial Sequence: Synthetic polypeptide
NEMVIGTTNPVATEQYGCLGVAWDGSPVEFETMDKQ

SEQ ID NO: 205833 - protein, 38 aa, Artificial Sequence
  Description of Artificial Sequence: Synthetic polypeptide
EIEEIATTNPVAYEQWGVVCYQVTNNEHNQTRDDTDGV

SEQ ID NO: 205834 - protein, 39 aa, Artificial Sequence
  Description of Artificial Sequence: Synthetic polypeptide
DEECIRTTNPVATEIYGICVCGNWGEDDNAEYFGSDTQS

SEQ ID NO: 205835 - protein, 37 aa, Artificial Sequence
  Description of Artificial Sequence: Synthetic polypeptide
EIEEIATTNPVAYEQWGVVCYQVMNNEHNQRDDTDGE

SEQ ID NO: 205836 - protein, 37 aa, Artificial Sequence
  Description of Artificial Sequence: Synthetic polypeptide
DEQEIATTNPVATEQWGGCCAAQGAPDNTAAPGEGVH

SEQ ID NO: 205837 - protein, 33 aa, Artificial Sequence
  Description of Artificial Sequence: Synthetic polypeptide
DDSEVASTNPVSTEGWGATTAAATIQSPVGQYR

SEQ ID NO: 205838 - protein, 38 aa, Artificial Sequence
  Description of Artificial Sequence: Synthetic polypeptide
AEAAISTTNPVATEQYGCVCSNWGEDHNQENFNSDTQA

SEQ ID NO: 205839 - protein, 38 aa, Artificial Sequence
  Description of Artificial Sequence: Synthetic polypeptide
DELNEIATTNPVAYERWGEVCSTPNQGNHGEEGGDGEN

SEQ ID NO: 205840 - protein, 38 aa, Artificial Sequence
  Description of Artificial Sequence: Synthetic polypeptide
VEDEIACTNPVATEQWGHSVNANAGAPTNNPGSENDMK

SEQ ID NO: 205841 - protein, 37 aa, Artificial Sequence
  Description of Artificial Sequence: Synthetic polypeptide
QENEIATTNPVAYEPYGNTVAGENHLNGNHGMEMQLN

SEQ ID NO: 205842 - protein, 37 aa, Artificial Sequence
  Description of Artificial Sequence: Synthetic polypeptide
AEEEIACVNPVGYEQYGCVCSNWGEHNAESFGSDNQA

SEQ ID NO: 205843 - protein, 38 aa, Artificial Sequence
  Description of Artificial Sequence: Synthetic polypeptide
AEAAIRTTNPVAYEQYGQCVCSNWEEHNAENFNSDFQS

SEQ ID NO: 205844 - protein, 39 aa, Artificial Sequence
  Description of Artificial Sequence: Synthetic polypeptide
DEAEISTTNPVATEYYGQCVCSNWGEDHNAEFFNSDTQS

SEQ ID NO: 205845 - protein, 39 aa, Artificial Sequence
  Description of Artificial Sequence: Synthetic polypeptide
DEDEIATTNPVAYEQWGVACYTGDNLHNDFQNTQGQDDD

SEQ ID NO: 205846 - protein, 39 aa, Artificial Sequence
  Description of Artificial Sequence: Synthetic polypeptide
DEMCIATTNPVAYEQYGQCVCSTWGEDHNAEHFGSETQA

SEQ ID NO: 205847 - protein, 38 aa, Artificial Sequence
  Description of Artificial Sequence: Synthetic polypeptide
SDAEISTTNPVATEQYGQCVCSNWGEHNAENFNSDTQA

SEQ ID NO: 205848 - protein, 38 aa, Artificial Sequence
  Description of Artificial Sequence: Synthetic polypeptide
ADMEISTTNPVATEQYGCVCSNWGEDHNAENFNSDNQS

SEQ ID NO: 205849 - protein, 38 aa, Artificial Sequence
  Description of Artificial Sequence: Synthetic polypeptide
DEMCIATTNPVAYEQYGQCVCSNWGEHNAEHFISENQA

SEQ ID NO: 205850 - protein, 38 aa, Artificial Sequence
  Description of Artificial Sequence: Synthetic polypeptide
DEMEISTTNPVAYEQYGQCVCGNWGEHNAENFNSDNQS

SEQ ID NO: 205851 - protein, 37 aa, Artificial Sequence
  Description of Artificial Sequence: Synthetic polypeptide
AEMEIATTNPVATEQYGQCYCPWGEDNQEHFNSETQA

SEQ ID NO: 205852 - protein, 38 aa, Artificial Sequence
  Description of Artificial Sequence: Synthetic polypeptide
DDAEISTTNPVATEGYGQCVCSNWGEHNAENFNSDTQQ

SEQ ID NO: 205853 - protein, 35 aa, Artificial Sequence
  Description of Artificial Sequence: Synthetic polypeptide
DETELRTTNPIATECWGATTWANAEDWAEPKGTYI

SEQ ID NO: 205854 - protein, 38 aa, Artificial Sequence
  Description of Artificial Sequence: Synthetic polypeptide
DEAEISTTNGVAYCQYGQCVCSWGEDHNAEYFGSDNQS

SEQ ID NO: 205855 - protein, 39 aa, Artificial Sequence
  Description of Artificial Sequence: Synthetic polypeptide
AENEISTTNPVAYEQYGQCVCSNWGEDTNAEHFNSDTQS

SEQ ID NO: 205856 - protein, 37 aa, Artificial Sequence
  Description of Artificial Sequence: Synthetic polypeptide
DEAEISTTNPCATEEYGCVCGNWGEHNAENFISDTAA

SEQ ID NO: 205857 - protein, 37 aa, Artificial Sequence
  Description of Artificial Sequence: Synthetic polypeptide
DEAEISTTNPCATEGYGCCCSNWGEDNAENFNSDTQA

SEQ ID NO: 205858 - protein, 38 aa, Artificial Sequence
  Description of Artificial Sequence: Synthetic polypeptide
SENEIATTNPVAYEGYGQCVCSTWGEDNAEHFISENQA

SEQ ID NO: 205859 - protein, 35 aa, Artificial Sequence
  Description of Artificial Sequence: Synthetic polypeptide
DETEIRTTNPIATECWGAQTWANAEDWAEPKEPYI

SEQ ID NO: 205860 - protein, 35 aa, Artificial Sequence
  Description of Artificial Sequence: Synthetic polypeptide
DETEIRTTNPIATECWGAQTWAEAEDWAEPKGPYI

SEQ ID NO: 205861 - protein, 36 aa, Artificial Sequence
  Description of Artificial Sequence: Synthetic polypeptide
SENEIATTNPVAYEGYGCVCSWEDHNAEHFISETQA

SEQ ID NO: 205862 - protein, 36 aa, Artificial Sequence
  Description of Artificial Sequence: Synthetic polypeptide
DETEIRTTNPIATECWGAMTWANAEEMWAEPKGPYI

SEQ ID NO: 205863 - protein, 36 aa, Artificial Sequence
  Description of Artificial Sequence: Synthetic polypeptide
DETEIRTTNPIATECWGAMTWANAEDWAEPKGPYIS

SEQ ID NO: 205864 - protein, 39 aa, Artificial Sequence
  Description of Artificial Sequence: Synthetic polypeptide
DEAEISTTNPCATEQYGQCVCSNWGEDHNAENFNSQTQS

SEQ ID NO: 205865 - protein, 37 aa, Artificial Sequence
  Description of Artificial Sequence: Synthetic polypeptide
SENEIATTNPVATEGYGQCVCSWGEDNQEHFISEPQA

SEQ ID NO: 205866 - protein, 38 aa, Artificial Sequence
  Description of Artificial Sequence: Synthetic polypeptide
SENEIATTNPVATEGYGQCVCSWGEDHNAEHFISDNQA

SEQ ID NO: 205867 - protein, 37 aa, Artificial Sequence
  Description of Artificial Sequence: Synthetic polypeptide
SENEIATTNPVATEGYGQCVCSWGEDDNAHFISETQA

SEQ ID NO: 205868 - protein, 38 aa, Artificial Sequence
  Description of Artificial Sequence: Synthetic polypeptide
SENEIATTNPVATEGYGQCVCSMWGEHNAEHFISENQA

SEQ ID NO: 205869 - protein, 35 aa, Artificial Sequence
  Description of Artificial Sequence: Synthetic polypeptide
DETEIRTTNPIATECWGAHTWRNAEDWAEPKVPYI

SEQ ID NO: 205870 - protein, 37 aa, Artificial Sequence
  Description of Artificial Sequence: Synthetic polypeptide
SENEIATTNPVATEGYGCVCSWGEDHNTEHFISETLA

SEQ ID NO: 205871 - protein, 37 aa, Artificial Sequence
  Description of Artificial Sequence: Synthetic polypeptide
SENEIATTNPVATEGYGCVCSWGEDHNAEHFISQTQA

SEQ ID NO: 205872 - protein, 39 aa, Artificial Sequence
  Description of Artificial Sequence: Synthetic polypeptide
AENEISTTNPVATEQYGQCVCSNWGEDNNEENFNSDTQS

SEQ ID NO: 205873 - protein, 39 aa, Artificial Sequence
  Description of Artificial Sequence: Synthetic polypeptide
AENEISTTNPVATEQYGQCVCSNWGEDHNAEYFNSDTQS

SEQ ID NO: 205874 - protein, 39 aa, Artificial Sequence
  Description of Artificial Sequence: Synthetic polypeptide
AENEISTTNPVATEQYGQCVCSNWGEDHNAEHFNSDNQS

SEQ ID NO: 205875 - protein, 36 aa, Artificial Sequence
  Description of Artificial Sequence: Synthetic polypeptide
DETEIRTTNPIATECWGACTWANAEDWEEPQEPQIE

SEQ ID NO: 205876 - protein, 36 aa, Artificial Sequence
  Description of Artificial Sequence: Synthetic polypeptide
DETEIRTTNPIATECWGACTWANAEDWAEPQNPQIQ

SEQ ID NO: 205877 - protein, 36 aa, Artificial Sequence
  Description of Artificial Sequence: Synthetic polypeptide
DETEIRTTNPIATECWGACTWANAEDWAEPKGPYIE

SEQ ID NO: 205878 - protein, 36 aa, Artificial Sequence
  Description of Artificial Sequence: Synthetic polypeptide
DETEIRTTNPIATECWGAATYWANAEDWAEPKGPYI

SEQ ID NO: 205879 - protein, 38 aa, Artificial Sequence
  Description of Artificial Sequence: Synthetic polypeptide
DEAEISTTNGVAYCQYGQCVCSNWGEDNQEYFGSDNQS

SEQ ID NO: 205880 - protein, 36 aa, Artificial Sequence
  Description of Artificial Sequence: Synthetic polypeptide
DETEIRTTNPIATECWGAATWANAEDWCAEPKGPYI

SEQ ID NO: 205881 - protein, 35 aa, Artificial Sequence
  Description of Artificial Sequence: Synthetic polypeptide
HETEIRTTNPIATEAWGATTWANAEDWAEPKGPYI

SEQ ID NO: 205882 - protein, 38 aa, Artificial Sequence
  Description of Artificial Sequence: Synthetic polypeptide
DEGEIASTNPVATEQYGSSCFPAYSDSCEETCGDDDEY

SEQ ID NO: 205883 - protein, 39 aa, Artificial Sequence
  Description of Artificial Sequence: Synthetic polypeptide
DEAEISCTNPVATEQYGQCVCSNWGEDHNAEYFNSETQS

SEQ ID NO: 205884 - protein, 38 aa, Artificial Sequence
  Description of Artificial Sequence: Synthetic polypeptide
DDAAIRTTNPVAYEQYGCVCSNWEEDHNAENFNSDFQS

SEQ ID NO: 205885 - protein, 38 aa, Artificial Sequence
  Description of Artificial Sequence: Synthetic polypeptide
DEECISTTNPVAYEQYGQCVCGNWGEHDAESFNSDTQS

SEQ ID NO: 205886 - protein, 36 aa, Artificial Sequence
  Description of Artificial Sequence: Synthetic polypeptide
DETEIRTTNPIATECWGATIWANAEDWPAEPKGPYI

SEQ ID NO: 205887 - protein, 34 aa, Artificial Sequence
  Description of Artificial Sequence: Synthetic polypeptide
QEGEIACTNPCSYEQWGITCYCNDIQDHGDTERE

SEQ ID NO: 205888 - protein, 35 aa, Artificial Sequence
  Description of Artificial Sequence: Synthetic polypeptide
QEGEIACTNPCSYEQWGITCYCNDEQQDRGDTKRD

SEQ ID NO: 205889 - protein, 35 aa, Artificial Sequence
  Description of Artificial Sequence: Synthetic polypeptide
DETEIRTTNPIATECWGATIWANAEDWAEPKEPYI

SEQ ID NO: 205890 - protein, 35 aa, Artificial Sequence
  Description of Artificial Sequence: Synthetic polypeptide
DETEIRTTNPIATECWGATIWACAEDHAEPTGPYI

SEQ ID NO: 205891 - protein, 39 aa, Artificial Sequence
  Description of Artificial Sequence: Synthetic polypeptide
SENEIRTTNPVATEIYGQCVCSNWGEDHNAENFGSDTQA

SEQ ID NO: 205892 - protein, 39 aa, Artificial Sequence
  Description of Artificial Sequence: Synthetic polypeptide
DEECISTTNPVAYEQYGQCVCGNWGEDHNAEFFGSENQA

SEQ ID NO: 205893 - protein, 37 aa, Artificial Sequence
  Description of Artificial Sequence: Synthetic polypeptide
IEAEIACTNPVATEQWGGCNVAGTGGQDDNQMGGELH

SEQ ID NO: 205894 - protein, 37 aa, Artificial Sequence
  Description of Artificial Sequence: Synthetic polypeptide
DDAAISTTNPVATEQYGCFCSNWGEHNIENFGSDTQS

SEQ ID NO: 205895 - protein, 35 aa, Artificial Sequence
  Description of Artificial Sequence: Synthetic polypeptide
DETEIRTTNPIATECWGATCWANAEDWAEPKHPYI

SEQ ID NO: 205896 - protein, 34 aa, Artificial Sequence
  Description of Artificial Sequence: Synthetic polypeptide
AEQEIACTNPCSYEQWGITCYCNDQQDEGDTVRD

SEQ ID NO: 205897 - protein, 38 aa, Artificial Sequence
  Description of Artificial Sequence: Synthetic polypeptide
DEGEIATTNPVAYEQWGHCIIFAGNNGLVDNDGENDAK

SEQ ID NO: 205898 - protein, 38 aa, Artificial Sequence
  Description of Artificial Sequence: Synthetic polypeptide
DEGEIATTNPVAYEQWGHCIIFAGNSGLVDNDGENTAQ

SEQ ID NO: 205899 - protein, 39 aa, Artificial Sequence
  Description of Artificial Sequence: Synthetic polypeptide
DDAAISTTNPVATEQYGQCVCSNWGEDDNQEGFNSETQS

SEQ ID NO: 205900 - protein, 36 aa, Artificial Sequence
  Description of Artificial Sequence: Synthetic polypeptide
DAEEIATTNPVAYAQWGCNTAGNNGPTGAEGGNLEQ

SEQ ID NO: 205901 - protein, 37 aa, Artificial Sequence
  Description of Artificial Sequence: Synthetic polypeptide
DEAEISCTNPVAYEQYGCVCSMWGEDNAEGFISDTQA

SEQ ID NO: 205902 - protein, 39 aa, Artificial Sequence
  Description of Artificial Sequence: Synthetic polypeptide
DEGEIATTNPVAYEQWGHCNVAITNPQDENIGEGMESDD

SEQ ID NO: 205903 - protein, 36 aa, Artificial Sequence
  Description of Artificial Sequence: Synthetic polypeptide
DETEIRTTNPIATECWGATAWANAEDWWAVPKGPYD

SEQ ID NO: 205904 - protein, 38 aa, Artificial Sequence
  Description of Artificial Sequence: Synthetic polypeptide
DEGEIATTNPVAYEQWGHCVFAANTGGLEAIANPDVHG

SEQ ID NO: 205905 - protein, 38 aa, Artificial Sequence
  Description of Artificial Sequence: Synthetic polypeptide
DEAEISCTNPVAYEQYGQCVCSNWGEHNAENFNSDTQA

SEQ ID NO: 205906 - protein, 38 aa, Artificial Sequence
  Description of Artificial Sequence: Synthetic polypeptide
DEAEISCTNPVAYEQYGQCVCSWGEDHNIENFNSDTQS

SEQ ID NO: 205907 - protein, 37 aa, Artificial Sequence
  Description of Artificial Sequence: Synthetic polypeptide
DEAEISTTNGVAYCQYGCVCGNWGEHNAEYFGSDNQS

SEQ ID NO: 205908 - protein, 38 aa, Artificial Sequence
  Description of Artificial Sequence: Synthetic polypeptide
QEGEIGTTNPVATEQYGTVVVADDGGDEEEEEGGNMDI

SEQ ID NO: 205909 - protein, 35 aa, Artificial Sequence
  Description of Artificial Sequence: Synthetic polypeptide
DETEIRTTNPIATECWGAATWANAEDWAEPKEPYI

SEQ ID NO: 205910 - protein, 38 aa, Artificial Sequence
  Description of Artificial Sequence: Synthetic polypeptide
SENEIATTNPVATEGYGCVCSTWGEAHNAEHFISETQA

SEQ ID NO: 205911 - protein, 36 aa, Artificial Sequence
  Description of Artificial Sequence: Synthetic polypeptide
DETEIRTTNPIATECWGAATTWANAEDWAEPKMPYI

SEQ ID NO: 205912 - protein, 38 aa, Artificial Sequence
  Description of Artificial Sequence: Synthetic polypeptide
DETEIRTTNPCATEGWGCQYCQNAEEDNAENSGSDNQA

SEQ ID NO: 205913 - protein, 38 aa, Artificial Sequence
  Description of Artificial Sequence: Synthetic polypeptide
DETEIRTTNPCATEGWGCQTCVNWGEDNAENSGSDNQA

SEQ ID NO: 205914 - protein, 38 aa, Artificial Sequence
  Description of Artificial Sequence: Synthetic polypeptide
DEAEISTTNPVATEGYGQCVCGNWGEHNAENFNSDTQS

SEQ ID NO: 205915 - protein, 37 aa, Artificial Sequence
  Description of Artificial Sequence: Synthetic polypeptide
DETEIRTTNPCATEGWGCQTCGNAEEDNAENSGSETI

SEQ ID NO: 205916 - protein, 38 aa, Artificial Sequence
  Description of Artificial Sequence: Synthetic polypeptide
DETEIRTTNPCATEGWGCQSCQNWEEDNAENSGSDNQN

SEQ ID NO: 205917 - protein, 37 aa, Artificial Sequence
  Description of Artificial Sequence: Synthetic polypeptide
DETEIRTTNPCATEEWGCQTCGNAEDHAEYSGSDNIA

SEQ ID NO: 205918 - protein, 39 aa, Artificial Sequence
  Description of Artificial Sequence: Synthetic polypeptide
DEAEISTTNPVATEGYGQCVCQNWGEDHNAENFGSENQS

SEQ ID NO: 205919 - protein, 37 aa, Artificial Sequence
  Description of Artificial Sequence: Synthetic polypeptide
DEAEISTTNPVATEGYGQCVCQWGAHNIENFMSDTQS

SEQ ID NO: 205920 - protein, 38 aa, Artificial Sequence
  Description of Artificial Sequence: Synthetic polypeptide
SEMEISTTNPVATEGYGQCVCSNWGEHNAEHFNSDTQA

SEQ ID NO: 205921 - protein, 39 aa, Artificial Sequence
  Description of Artificial Sequence: Synthetic polypeptide
DEAEISTTNPVATEGYGQCVCSMWEEDHNQENFNSDTQS

SEQ ID NO: 205922 - protein, 38 aa, Artificial Sequence
  Description of Artificial Sequence: Synthetic polypeptide
SEMEISTTNPVATEGYGCVCSNWGEDHNEENFNSENQS

SEQ ID NO: 205923 - protein, 39 aa, Artificial Sequence
  Description of Artificial Sequence: Synthetic polypeptide
DEAEISTTNPVATEGYGQCVCSNWEELHNAENFNSDNQS

SEQ ID NO: 205924 - protein, 37 aa, Artificial Sequence
  Description of Artificial Sequence: Synthetic polypeptide
SEMEISCTNPVATEQYGCVCENWGEDNAENFGSDTQA

SEQ ID NO: 205925 - protein, 37 aa, Artificial Sequence
  Description of Artificial Sequence: Synthetic polypeptide
SEMEISCTNPCATEQYGCVCSNWMEHNAENFGSDTQS

SEQ ID NO: 205926 - protein, 38 aa, Artificial Sequence
  Description of Artificial Sequence: Synthetic polypeptide
DEDEIRTTNPVATEQWGCMCAGAGMHPGDLHPDDSLNN

SEQ ID NO: 205927 - protein, 38 aa, Artificial Sequence
  Description of Artificial Sequence: Synthetic polypeptide
DDACIRTTNPVATEQYGQCVCSNWGEHNQENFISDTQS

SEQ ID NO: 205928 - protein, 38 aa, Artificial Sequence
  Description of Artificial Sequence: Synthetic polypeptide
DETEIRTTNPVAYEQWGHNEVYYWEEQQHQHPKEGKED

SEQ ID NO: 205929 - protein, 39 aa, Artificial Sequence
  Description of Artificial Sequence: Synthetic polypeptide
DEAEISTTNPVATEGYGQCVCSNWGEDHNAENFGSETQS

SEQ ID NO: 205930 - protein, 39 aa, Artificial Sequence
  Description of Artificial Sequence: Synthetic polypeptide
DEAEISTTNPVATEGYGQCVCSNWGEDHNAENFNSDNQA

SEQ ID NO: 205931 - protein, 39 aa, Artificial Sequence
  Description of Artificial Sequence: Synthetic polypeptide
DEAEISTTNPVATEGYGQCVCSNWGEDHNAENFNSDNQM

SEQ ID NO: 205932 - protein, 38 aa, Artificial Sequence
  Description of Artificial Sequence: Synthetic polypeptide
DEECISTTNPVAYEQYGCVCSNWEEDHNQENFISDTQS

SEQ ID NO: 205933 - protein, 39 aa, Artificial Sequence
  Description of Artificial Sequence: Synthetic polypeptide
SEMEIRTTNPVATCQYGQCVCSNWGEDHNEEYFNSDTQS

SEQ ID NO: 205934 - protein, 39 aa, Artificial Sequence
  Description of Artificial Sequence: Synthetic polypeptide
DEAEISTTNPVATEGYGQCVCSNWGEDHNAENFNSDTQL

SEQ ID NO: 205935 - protein, 39 aa, Artificial Sequence
  Description of Artificial Sequence: Synthetic polypeptide
DEAEISTTNPVATEGYGQCVCSNWGEDHNAENFNSDTQP

SEQ ID NO: 205936 - protein, 39 aa, Artificial Sequence
  Description of Artificial Sequence: Synthetic polypeptide
DEAEISTTNPVATEGYGQCVCSNWGEDHNAENFNSDTQS

SEQ ID NO: 205937 - protein, 38 aa, Artificial Sequence
  Description of Artificial Sequence: Synthetic polypeptide
DEAEISTTNPVATEGYGQCVCGNWGEHNAENFNSDTQA

SEQ ID NO: 205938 - protein, 39 aa, Artificial Sequence
  Description of Artificial Sequence: Synthetic polypeptide
DEAEISTTNPVATEGYGQCVCGNWGEDHNIEGFNSDTQA

SEQ ID NO: 205939 - protein, 39 aa, Artificial Sequence
  Description of Artificial Sequence: Synthetic polypeptide
DEAEISTTNPVATEGYGQCVCGNWGEDHNAEGFNSDTQA

SEQ ID NO: 205940 - protein, 38 aa, Artificial Sequence
  Description of Artificial Sequence: Synthetic polypeptide
SEMEISTTNPVAYEQYGCVCSNWGEDPNAEFFGSDTQA

SEQ ID NO: 205941 - protein, 37 aa, Artificial Sequence
  Description of Artificial Sequence: Synthetic polypeptide
DETEIRTTNPIATECWGAATTWANAEDWAEPKGSPYI

SEQ ID NO: 205942 - protein, 39 aa, Artificial Sequence
  Description of Artificial Sequence: Synthetic polypeptide
DEAEISTTNPVATEEYGQCVCSNWEEDHNAENFNSDTQS

SEQ ID NO: 205943 - protein, 37 aa, Artificial Sequence
  Description of Artificial Sequence: Synthetic polypeptide
SENEIATTNPVATEGYGCVCQNWMEHNAEHFISETQA

SEQ ID NO: 205944 - protein, 36 aa, Artificial Sequence
  Description of Artificial Sequence: Synthetic polypeptide
DETEIRTTNPIATEAWGCQTCQNAEDPAEYSGSDTQ

SEQ ID NO: 205945 - protein, 39 aa, Artificial Sequence
  Description of Artificial Sequence: Synthetic polypeptide
DEAEISTTNPVATEEYGQCVCSNWEEDHNIEGFNSDTQS

SEQ ID NO: 205946 - protein, 39 aa, Artificial Sequence
  Description of Artificial Sequence: Synthetic polypeptide
DEAEISTTNPVATEEYGQCVCSNWGEDHNAENFNSDNQA

SEQ ID NO: 205947 - protein, 38 aa, Artificial Sequence
  Description of Artificial Sequence: Synthetic polypeptide
AENEISTTNPCATEQYGQCVCSNWGEHNAENFNSDTQS

SEQ ID NO: 205948 - protein, 36 aa, Artificial Sequence
  Description of Artificial Sequence: Synthetic polypeptide
DETEIRTTNPIATEAWGATTVACAEDEHAEPTGPYI

SEQ ID NO: 205949 - protein, 38 aa, Artificial Sequence
  Description of Artificial Sequence: Synthetic polypeptide
DEAEISTTNPVATEGWGCVCSNWGEDENAEYFGSQTQS

SEQ ID NO: 205950 - protein, 38 aa, Artificial Sequence
  Description of Artificial Sequence: Synthetic polypeptide
DDACIRTTNPVATEQYGCCCSNWGEDHNQEHFGSDTQA

SEQ ID NO: 205951 - protein, 40 aa, Artificial Sequence
  Description of Artificial Sequence: Synthetic polypeptide
HEIVHEICTTNPVATEQYGSWCSSVEDTQVQIPVHSEGGG

SEQ ID NO: 205952 - protein, 35 aa, Artificial Sequence
  Description of Artificial Sequence: Synthetic polypeptide
DETEIRTTNPIATDCWGATTWANAEDWAEPKGPYI

SEQ ID NO: 205953 - protein, 37 aa, Artificial Sequence
  Description of Artificial Sequence: Synthetic polypeptide
DEAEIATTNPVAYCQYGCVCSWGADHNAENFISDTQS

SEQ ID NO: 205954 - protein, 35 aa, Artificial Sequence
  Description of Artificial Sequence: Synthetic polypeptide
DETEIRTTNPIATDCWGATTWANAEDFAEPKGPYI

SEQ ID NO: 205955 - protein, 37 aa, Artificial Sequence
  Description of Artificial Sequence: Synthetic polypeptide
SENEIACTNPVATEGYGQCVCSWGEDNAEHFISENQA

SEQ ID NO: 205956 - protein, 37 aa, Artificial Sequence
  Description of Artificial Sequence: Synthetic polypeptide
SENEIACTNPVATEGYGCVCSWGEDDNQEHFISENQA

SEQ ID NO: 205957 - protein, 36 aa, Artificial Sequence
  Description of Artificial Sequence: Synthetic polypeptide
MEGEIRTTNPVATEQYGCWWAAGREDEEWEFFSLQI

SEQ ID NO: 205958 - protein, 39 aa, Artificial Sequence
  Description of Artificial Sequence: Synthetic polypeptide
MEGEIRTTNPVATEQYGESPIDWWKIHNMQDQEPVSQEP

SEQ ID NO: 205959 - protein, 37 aa, Artificial Sequence
  Description of Artificial Sequence: Synthetic polypeptide
DEAEISTTNPVATEGYGCTCSNWGEHNAENFISDTQS

SEQ ID NO: 205960 - protein, 38 aa, Artificial Sequence
  Description of Artificial Sequence: Synthetic polypeptide
SENCIATTNPVATEGYGCVCSTWGEDHNAEHFISENQA

SEQ ID NO: 205961 - protein, 37 aa, Artificial Sequence
  Description of Artificial Sequence: Synthetic polypeptide
SENAIATTNPVATEGYGCVCSNWGEHNAEHFISENQA

SEQ ID NO: 205962 - protein, 38 aa, Artificial Sequence
  Description of Artificial Sequence: Synthetic polypeptide
DEAEISTTNPVATEGYGICVCSNWVEDNIENFISDTQS

SEQ ID NO: 205963 - protein, 37 aa, Artificial Sequence
  Description of Artificial Sequence: Synthetic polypeptide
DEDEIRTTNPVATEQWGCCTAGAGAHPGDLHPDDSHN

SEQ ID NO: 205964 - protein, 38 aa, Artificial Sequence
  Description of Artificial Sequence: Synthetic polypeptide
DEDEIRTTNPVATEQWGCICAGAGAHPGDLHPDDSLNG

SEQ ID NO: 205965 - protein, 36 aa, Artificial Sequence
  Description of Artificial Sequence: Synthetic polypeptide
QEEEIATTNPVATYAPWGHSACAAANGDTSQEVDDQ

SEQ ID NO: 205966 - protein, 36 aa, Artificial Sequence
  Description of Artificial Sequence: Synthetic polypeptide
QEEEIATTNPVATYAPWGHSACAAANGLNSDEVDDQ

SEQ ID NO: 205967 - protein, 37 aa, Artificial Sequence
  Description of Artificial Sequence: Synthetic polypeptide
DEDEIACTNPVAYAQWGSVCSPANPALGEHMIDITAM

SEQ ID NO: 205968 - protein, 36 aa, Artificial Sequence
  Description of Artificial Sequence: Synthetic polypeptide
AEQEIATTNPVAYEQWGCNVASDGFTEAGMPLEEDA

SEQ ID NO: 205969 - protein, 37 aa, Artificial Sequence
  Description of Artificial Sequence: Synthetic polypeptide
DEAEIATTNPVAYCGYGCVCSNWGAHNQENFNSDTQS

SEQ ID NO: 205970 - protein, 39 aa, Artificial Sequence
  Description of Artificial Sequence: Synthetic polypeptide
DEAEISCTNPVATEQYGQCVCSNWGEDDNQENFNSDNQS

SEQ ID NO: 205971 - protein, 37 aa, Artificial Sequence
  Description of Artificial Sequence: Synthetic polypeptide
DEAEIRTTNPVSTEGYGCICSNWEEHNAEHFISDTQS

SEQ ID NO: 205972 - protein, 39 aa, Artificial Sequence
  Description of Artificial Sequence: Synthetic polypeptide
DEMEIATTNPVAYEQYGQCVCSNWMEAHNEEHFGSETQA

SEQ ID NO: 205973 - protein, 39 aa, Artificial Sequence
  Description of Artificial Sequence: Synthetic polypeptide
DEECISTTNPVAYEQYGQCVCSNWMEDHNAEYFNSQTQA

SEQ ID NO: 205974 - protein, 39 aa, Artificial Sequence
  Description of Artificial Sequence: Synthetic polypeptide
DEECISTTNPVAYEQYGQCVCSNWMEDHNAENFNSETQA

SEQ ID NO: 205975 - protein, 39 aa, Artificial Sequence
  Description of Artificial Sequence: Synthetic polypeptide
DEECISTTNPVAYEQYGQCVCSNWMEDHNAENFNSDNQA

SEQ ID NO: 205976 - protein, 39 aa, Artificial Sequence
  Description of Artificial Sequence: Synthetic polypeptide
DEECISTTNPVAYEQYGQCVCSNWGEPHNAENFNSETQA

SEQ ID NO: 205977 - protein, 39 aa, Artificial Sequence
  Description of Artificial Sequence: Synthetic polypeptide
DEECISTTNPVAYEQYGQCVCSNWGEPHNAENFNSDTQS

SEQ ID NO: 205978 - protein, 36 aa, Artificial Sequence
  Description of Artificial Sequence: Synthetic polypeptide
DETEIRTTNPIATECWGATTPANAEGWAEPKGDYIT

SEQ ID NO: 205979 - protein, 36 aa, Artificial Sequence
  Description of Artificial Sequence: Synthetic polypeptide
DETEIRTTNPIATECWGATTPANAEDWAEPKGPYII

SEQ ID NO: 205980 - protein, 35 aa, Artificial Sequence
  Description of Artificial Sequence: Synthetic polypeptide
DETEIRTTNPIATECWGATTPANAEDWAEPKFPYI

SEQ ID NO: 205981 - protein, 36 aa, Artificial Sequence
  Description of Artificial Sequence: Synthetic polypeptide
DETEIRTTNPIATECWGATTPANAADWMAEPKGPYM

SEQ ID NO: 205982 - protein, 38 aa, Artificial Sequence
  Description of Artificial Sequence: Synthetic polypeptide
MEEEISTTNPVAYEQYGQCVCQNWGEHNTENFNSETQL

SEQ ID NO: 205983 - protein, 38 aa, Artificial Sequence
  Description of Artificial Sequence: Synthetic polypeptide
DENEIATTNPVAYYEPQWGCVAGNNADIQANAGDDSAM

SEQ ID NO: 205984 - protein, 39 aa, Artificial Sequence
  Description of Artificial Sequence: Synthetic polypeptide
SEQEISTTNPVATEGYGVVDVGVGTGNVGQQEGEGEDTT

SEQ ID NO: 205985 - protein, 39 aa, Artificial Sequence
  Description of Artificial Sequence: Synthetic polypeptide
SEQEISTTNPVATEGYGVVDVGVGTGNNGQQEGEGEETI

SEQ ID NO: 205986 - protein, 38 aa, Artificial Sequence
  Description of Artificial Sequence: Synthetic polypeptide
DEGEIATTNPVATAQWGHSASAVGDWIEADTPGGEDNH

SEQ ID NO: 205987 - protein, 38 aa, Artificial Sequence
  Description of Artificial Sequence: Synthetic polypeptide
DEGEIATTNPVATAQWGHSASAVGDPPEADTPNGEDNH

SEQ ID NO: 205988 - protein, 38 aa, Artificial Sequence
  Description of Artificial Sequence: Synthetic polypeptide
DEGEIATTNPVATAQWGHSASAVGDPLEADTPIIEDNH

SEQ ID NO: 205989 - protein, 39 aa, Artificial Sequence
  Description of Artificial Sequence: Synthetic polypeptide
DEECISTTNPVAYEQYGQCVCSNWGEDHNQEYFGSDTQA

SEQ ID NO: 205990 - protein, 39 aa, Artificial Sequence
  Description of Artificial Sequence: Synthetic polypeptide
DEECISTTNPVAYEQYGQCVCSNWGEDHNEENFNSDTQA

SEQ ID NO: 205991 - protein, 39 aa, Artificial Sequence
  Description of Artificial Sequence: Synthetic polypeptide
MEEEVRTTTVNNPVATQRGPSTSLQMTRQIRIQDGGNET

SEQ ID NO: 205992 - protein, 38 aa, Artificial Sequence
  Description of Artificial Sequence: Synthetic polypeptide
DEGEIATTNPVATAQWGHSASAVGDPLEADMPGGEDLH

SEQ ID NO: 205993 - protein, 37 aa, Artificial Sequence
  Description of Artificial Sequence: Synthetic polypeptide
DETEIRTTNPIATECWGATTPACAEDEWAQPTGGPNI

SEQ ID NO: 205994 - protein, 35 aa, Artificial Sequence
  Description of Artificial Sequence: Synthetic polypeptide
DETEIRTTNPIATECWGATTMAPAEDWAEPKGPYI

SEQ ID NO: 205995 - protein, 34 aa, Artificial Sequence
  Description of Artificial Sequence: Synthetic polypeptide
QEGEIACTNPCSYEQWGITCYCNDQQDHNDTVRM

SEQ ID NO: 205996 - protein, 36 aa, Artificial Sequence
  Description of Artificial Sequence: Synthetic polypeptide
DETEIRTTNPIATECWGATTPANATDPWAEPKGPYP

SEQ ID NO: 205997 - protein, 38 aa, Artificial Sequence
  Description of Artificial Sequence: Synthetic polypeptide
SESEIACTNPVGTEGYGQVSCGNSGEDNQEHFGSDNQS

SEQ ID NO: 205998 - protein, 36 aa, Artificial Sequence
  Description of Artificial Sequence: Synthetic polypeptide
DETEIRTTNPIATECWGATTPANVEDIAEIEGEPDM

SEQ ID NO: 205999 - protein, 38 aa, Artificial Sequence
  Description of Artificial Sequence: Synthetic polypeptide
DENEIATTNPVSTEGYGCICSNWEEDDNAEYFGSDNQS

SEQ ID NO: 206000 - protein, 37 aa, Artificial Sequence
  Description of Artificial Sequence: Synthetic polypeptide
SESEIRTTNPVATEQWGCYNKETIPLEEFTEEEIHED

SEQ ID NO: 206001 - protein, 40 aa, Artificial Sequence
  Description of Artificial Sequence: Synthetic polypeptide
DEEEISTTNPVATEQYGQCAVCQNSGEDHNAENFPSETQA

SEQ ID NO: 206002 - protein, 40 aa, Artificial Sequence
  Description of Artificial Sequence: Synthetic polypeptide
DEEEISTTNPVATEQYGQCAVCSNWGEDHNAENFISDTQS

SEQ ID NO: 206003 - protein, 36 aa, Artificial Sequence
  Description of Artificial Sequence: Synthetic polypeptide
DETEIRTTNPIATECWGATTVACAEDHSAEPTEPYI

SEQ ID NO: 206004 - protein, 40 aa, Artificial Sequence
  Description of Artificial Sequence: Synthetic polypeptide
DEEEISTTNPVATEQYGQCQVCGNWGPDHNAENFNSETQA

SEQ ID NO: 206005 - protein, 40 aa, Artificial Sequence
  Description of Artificial Sequence: Synthetic polypeptide
DEEEISTTNPVATEQYGQCQVCGNWGYDHNAENFNSDNQS

SEQ ID NO: 206006 - protein, 40 aa, Artificial Sequence
  Description of Artificial Sequence: Synthetic polypeptide
DEEEISTTNPVATEQYGQCQVCSMWGEDHNAENFISDFQS

SEQ ID NO: 206007 - protein, 38 aa, Artificial Sequence
  Description of Artificial Sequence: Synthetic polypeptide
DEGEIATTNPVATEMWGCVVATGGHQLDEATPDDNPHM

SEQ ID NO: 206008 - protein, 40 aa, Artificial Sequence
  Description of Artificial Sequence: Synthetic polypeptide
DEEEISTTNPVATEQYGQCQVCSNWGEDHNAENFISDTQS

SEQ ID NO: 206009 - protein, 40 aa, Artificial Sequence
  Description of Artificial Sequence: Synthetic polypeptide
DEEEISTTNPVATEQYGQCQVCSNWGEDHNIENFISDTQS

SEQ ID NO: 206010 - protein, 40 aa, Artificial Sequence
  Description of Artificial Sequence: Synthetic polypeptide
DEEEISTTNPVATEQYGQCQVCSNWGEDHNQENFFSDTQS

SEQ ID NO: 206011 - protein, 37 aa, Artificial Sequence
  Description of Artificial Sequence: Synthetic polypeptide
DETEIRTTNPIATECWGATTSACAEDHSAEPTGGPYI

SEQ ID NO: 206012 - protein, 36 aa, Artificial Sequence
  Description of Artificial Sequence: Synthetic polypeptide
SEQEIATTNPVAYEQWGCTFAGNNGLATAGFPQPFE

SEQ ID NO: 206013 - protein, 39 aa, Artificial Sequence
  Description of Artificial Sequence: Synthetic polypeptide
QEGEVATTNPVATEQYGNISFSAPDDTGREPHEKQFDTR

SEQ ID NO: 206014 - protein, 36 aa, Artificial Sequence
  Description of Artificial Sequence: Synthetic polypeptide
DETEIRTTNPVATECWGATTWAAIDWPAEPEGEPYI

SEQ ID NO: 206015 - protein, 36 aa, Artificial Sequence
  Description of Artificial Sequence: Synthetic polypeptide
DETEIRTTNPVATECWGATTWACIDWPAEPEGEPYI

SEQ ID NO: 206016 - protein, 36 aa, Artificial Sequence
  Description of Artificial Sequence: Synthetic polypeptide
DETEIRTTNPIATECWGATTRANAEDWAEPKGMPYI

SEQ ID NO: 206017 - protein, 36 aa, Artificial Sequence
  Description of Artificial Sequence: Synthetic polypeptide
DETEIRTTNPIATECWGATTRANAEDMWAEPKGPYI

SEQ ID NO: 206018 - protein, 35 aa, Artificial Sequence
  Description of Artificial Sequence: Synthetic polypeptide
DETEIRTTNPIATECWGATTRAGAEDWAEPKGPYI

SEQ ID NO: 206019 - protein, 35 aa, Artificial Sequence
  Description of Artificial Sequence: Synthetic polypeptide
DETEIRTTNPIATECWGATTQAYAEDWAEPNGPYI

SEQ ID NO: 206020 - protein, 36 aa, Artificial Sequence
  Description of Artificial Sequence: Synthetic polypeptide
DETEIRTTNPIATECWGATTQANAEDWHAEPKGPYI

SEQ ID NO: 206021 - protein, 35 aa, Artificial Sequence
  Description of Artificial Sequence: Synthetic polypeptide
DETEIRTTNPIATECWGATTQACAEDWAEPTGPYE

SEQ ID NO: 206022 - protein, 39 aa, Artificial Sequence
  Description of Artificial Sequence: Synthetic polypeptide
DEAEIRTTNGVAYCQYGQCVCSNWGEDDNAENFGSDNQS

SEQ ID NO: 206023 - protein, 37 aa, Artificial Sequence
  Description of Artificial Sequence: Synthetic polypeptide
SESEIAPTNPCSYEQYGVTVSCCGHMLSQNSNGGTVR

SEQ ID NO: 206024 - protein, 35 aa, Artificial Sequence
  Description of Artificial Sequence: Synthetic polypeptide
DETEIRTTNPIATECWGATTPAYAEHWAEPTGPYI

SEQ ID NO: 206025 - protein, 39 aa, Artificial Sequence
  Description of Artificial Sequence: Synthetic polypeptide
DEMEIATTNPVAYEQYGICVCSNWMEDHNAEHFNSETQA

SEQ ID NO: 206026 - protein, 34 aa, Artificial Sequence
  Description of Artificial Sequence: Synthetic polypeptide
QAHEIATTNPVATASWGCNVAGAGLNTAGGDIFQ

SEQ ID NO: 206027 - protein, 39 aa, Artificial Sequence
  Description of Artificial Sequence: Synthetic polypeptide
DEAEISTTNPVATEGYGQCVCSNWGEDHNAENFNSETQG

SEQ ID NO: 206028 - protein, 39 aa, Artificial Sequence
  Description of Artificial Sequence: Synthetic polypeptide
DEECISTTNPVAYEQYGQCVCSNWGEDHNAEYFNSETQA

SEQ ID NO: 206029 - protein, 36 aa, Artificial Sequence
  Description of Artificial Sequence: Synthetic polypeptide
IERMMIRTTNPCATEATGTTVVYVTIGGENERIVVR

SEQ ID NO: 206030 - protein, 37 aa, Artificial Sequence
  Description of Artificial Sequence: Synthetic polypeptide
MEGEIRTTNPVATEQWGHADCWACTDMISFEGTEEHN

SEQ ID NO: 206031 - protein, 39 aa, Artificial Sequence
  Description of Artificial Sequence: Synthetic polypeptide
DEAEISCTNPVATEGYGQCVCSNWGEDTNAENFNSETQS

SEQ ID NO: 206032 - protein, 38 aa, Artificial Sequence
  Description of Artificial Sequence: Synthetic polypeptide
QAWEIATTNPVATEQYGNISFSAPPDTLREPHEIEDTR

SEQ ID NO: 206033 - protein, 39 aa, Artificial Sequence
  Description of Artificial Sequence: Synthetic polypeptide
QCEEIAATNPVAYEQWGSTVYTLWMNESNDHERGDDGND

SEQ ID NO: 206034 - protein, 39 aa, Artificial Sequence
  Description of Artificial Sequence: Synthetic polypeptide
DEECISTTNPVAYEQYGQCVCSNWGEDDNQENFNSDTQA

SEQ ID NO: 206035 - protein, 38 aa, Artificial Sequence
  Description of Artificial Sequence: Synthetic polypeptide
MEGEIRTTNPVATEQWGHAYCWACTDDMILSFEGEEHN

SEQ ID NO: 206036 - protein, 39 aa, Artificial Sequence
  Description of Artificial Sequence: Synthetic polypeptide
DEECISTTNPVAYEQYGQCVCSNWGEDDNAENFNSETQQ

SEQ ID NO: 206037 - protein, 37 aa, Artificial Sequence
  Description of Artificial Sequence: Synthetic polypeptide
MEGEIRTTNPVATEQWGHAYCWACTDMISDEGHEEHN

SEQ ID NO: 206038 - protein, 39 aa, Artificial Sequence
  Description of Artificial Sequence: Synthetic polypeptide
DEECISTTNPVAYEQYGQCVCSNWGEDDNAENFNSDTQS

SEQ ID NO: 206039 - protein, 39 aa, Artificial Sequence
  Description of Artificial Sequence: Synthetic polypeptide
DEECISTTNPVAYEQYGQCVCSNWEEDHNAENFNSDTQA

SEQ ID NO: 206040 - protein, 39 aa, Artificial Sequence
  Description of Artificial Sequence: Synthetic polypeptide
DEECISTTNPVAYEQYGQCVCSNWEEDHNAEHFNSQTQS

SEQ ID NO: 206041 - protein, 37 aa, Artificial Sequence
  Description of Artificial Sequence: Synthetic polypeptide
DAAEIATTNPVATEQWGCNCAGTGPHPGDNHPDDSNN

SEQ ID NO: 206042 - protein, 39 aa, Artificial Sequence
  Description of Artificial Sequence: Synthetic polypeptide
DEECISTTNPVAYEQYGQCVCSNWEEDHNAEAFNSDNQG

SEQ ID NO: 206043 - protein, 39 aa, Artificial Sequence
  Description of Artificial Sequence: Synthetic polypeptide
DEECISTTNPVAYEQYGQCVCSMWGEDHNAENSNSETQA

SEQ ID NO: 206044 - protein, 38 aa, Artificial Sequence
  Description of Artificial Sequence: Synthetic polypeptide
DEECISTTNPVAYEQYGQCVCQNWGEHNAENFNSDTQA

SEQ ID NO: 206045 - protein, 35 aa, Artificial Sequence
  Description of Artificial Sequence: Synthetic polypeptide
DCTEIRTTNPIATECWGACTWANAEDWAEPKGPYI

SEQ ID NO: 206046 - protein, 35 aa, Artificial Sequence
  Description of Artificial Sequence: Synthetic polypeptide
DAAEIACTNPVAYEQWGTTSSGAGPAGNPHGMAGM

SEQ ID NO: 206047 - protein, 36 aa, Artificial Sequence
  Description of Artificial Sequence: Synthetic polypeptide
DAAEIACTNPVAYEQWGTTSPGTGPAGNPHGDNGME

SEQ ID NO: 206048 - protein, 37 aa, Artificial Sequence
  Description of Artificial Sequence: Synthetic polypeptide
DAAEIACTNPVAYEQWGSVCAMANHADDSKAPGGNHN

SEQ ID NO: 206049 - protein, 38 aa, Artificial Sequence
  Description of Artificial Sequence: Synthetic polypeptide
DAAEIACTNPVATEQYGSVCAMANHADDSKAPGDSFEN

SEQ ID NO: 206050 - protein, 39 aa, Artificial Sequence
  Description of Artificial Sequence: Synthetic polypeptide
DEAEISCTNPVATEQYGQCVCGNWGEGHNAENFNSDNQA

SEQ ID NO: 206051 - protein, 36 aa, Artificial Sequence
  Description of Artificial Sequence: Synthetic polypeptide
DETEIRTTNPIATECWGATMWANAEDWAEPKGPYIS

SEQ ID NO: 206052 - protein, 36 aa, Artificial Sequence
  Description of Artificial Sequence: Synthetic polypeptide
MEGEIRTTNPVATEQWWGHACWACCEMISFEGEEHN

SEQ ID NO: 206053 - protein, 36 aa, Artificial Sequence
  Description of Artificial Sequence: Synthetic polypeptide
AEQEIATTNPVAYEQWGMTAMTRPQEETQQRQMEST

SEQ ID NO: 206054 - protein, 39 aa, Artificial Sequence
  Description of Artificial Sequence: Synthetic polypeptide
DEAEISCTNPVATEQYGQCVCSMWGEDHNAENFNSDPQA

SEQ ID NO: 206055 - protein, 34 aa, Artificial Sequence
  Description of Artificial Sequence: Synthetic polypeptide
QEGEIACTNPCSYEQWGITCYCNDQQDPGDTVRF

SEQ ID NO: 206056 - protein, 36 aa, Artificial Sequence
  Description of Artificial Sequence: Synthetic polypeptide
DEGEIATTNPIATECWGATYYANENDTQHEKTGKGM

SEQ ID NO: 206057 - protein, 39 aa, Artificial Sequence
  Description of Artificial Sequence: Synthetic polypeptide
DEECISTTNPVAYEQYGQCVCSNWGEDDNTEHFNSEFQS

SEQ ID NO: 206058 - protein, 35 aa, Artificial Sequence
  Description of Artificial Sequence: Synthetic polypeptide
DEGEIATTNPVAYEPWGHPACAAANGDAMQGDQHQ

SEQ ID NO: 206059 - protein, 39 aa, Artificial Sequence
  Description of Artificial Sequence: Synthetic polypeptide
MEGEIATTNPVATEWYGVSCSYPAPEEGPNMVFEGNSDC

SEQ ID NO: 206060 - protein, 39 aa, Artificial Sequence
  Description of Artificial Sequence: Synthetic polypeptide
DEECISTTNPVAYEQYGQCVCSNWGEDHNAEYFNSDNQS

SEQ ID NO: 206061 - protein, 39 aa, Artificial Sequence
  Description of Artificial Sequence: Synthetic polypeptide
DEECISTTNPVAYEQYGQCVCSNWGEDHNAEYFISENQA

SEQ ID NO: 206062 - protein, 36 aa, Artificial Sequence
  Description of Artificial Sequence: Synthetic polypeptide
DETEIRTTNPIATECWGATTIANAEDWAEPKGPYIC

SEQ ID NO: 206063 - protein, 39 aa, Artificial Sequence
  Description of Artificial Sequence: Synthetic polypeptide
DEECISTTNPVAYEQYGQCVCSNWGEDHNAESFNSDTQA

SEQ ID NO: 206064 - protein, 39 aa, Artificial Sequence
  Description of Artificial Sequence: Synthetic polypeptide
DEECISTTNPVAYEQYGQCVCSNWGEDHNAENSNSDNQS

SEQ ID NO: 206065 - protein, 39 aa, Artificial Sequence
  Description of Artificial Sequence: Synthetic polypeptide
DEECISTTNPVAYEQYGQCVCSNWGEDHNAENFNSDTQS

SEQ ID NO: 206066 - protein, 39 aa, Artificial Sequence
  Description of Artificial Sequence: Synthetic polypeptide
DEECISTTNPVAYEQYGQCVCSNWGEDHNAENFNSDNQS

SEQ ID NO: 206067 - protein, 39 aa, Artificial Sequence
  Description of Artificial Sequence: Synthetic polypeptide
SEPEIRTTNPVATEQWGASAVVAWPVHHLIENGQEDQEY

SEQ ID NO: 206068 - protein, 39 aa, Artificial Sequence
  Description of Artificial Sequence: Synthetic polypeptide
DEECISTTNPVAYEQYGQCVCSNWGEDHNAENFNSDFQS

SEQ ID NO: 206069 - protein, 35 aa, Artificial Sequence
  Description of Artificial Sequence: Synthetic polypeptide
DETEIRTTNPIATECWGATTFANAEDWAEPKWPYI

SEQ ID NO: 206070 - protein, 39 aa, Artificial Sequence
  Description of Artificial Sequence: Synthetic polypeptide
DEECISTTNPVAYEQYGQCVCSNWGEDHNAENFGSDTQS

SEQ ID NO: 206071 - protein, 39 aa, Artificial Sequence
  Description of Artificial Sequence: Synthetic polypeptide
DEECISTTNPVAYEQYGQCVCSNWGEDHNAEYFNSDTQS

SEQ ID NO: 206072 - protein, 39 aa, Artificial Sequence
  Description of Artificial Sequence: Synthetic polypeptide
DEECISTTNPVAYEQYGQCVCSNWGEDHNAEGFNSDNQA

SEQ ID NO: 206073 - protein, 37 aa, Artificial Sequence
  Description of Artificial Sequence: Synthetic polypeptide
SENEISTTNPVATEQWGCVCSNSGEENAENSSSDTAA

SEQ ID NO: 206074 - protein, 39 aa, Artificial Sequence
  Description of Artificial Sequence: Synthetic polypeptide
DAAEIATTNPVATEQYGSTACALANPAEGQEHQDGMQMN

SEQ ID NO: 206075 - protein, 39 aa, Artificial Sequence
  Description of Artificial Sequence: Synthetic polypeptide
DEGEIATTNPVATAQWGAHVVAANTGNGGEYGAEGDGNT

SEQ ID NO: 206076 - protein, 38 aa, Artificial Sequence
  Description of Artificial Sequence: Synthetic polypeptide
AEREISTTNPVAYEQYGQCVCSNWGEHNAENFNSDNQS

SEQ ID NO: 206077 - protein, 39 aa, Artificial Sequence
  Description of Artificial Sequence: Synthetic polypeptide
AEREISTTNPVATEQYGQCVCSNWMEDHNAENFNSDTQS

SEQ ID NO: 206078 - protein, 38 aa, Artificial Sequence
  Description of Artificial Sequence: Synthetic polypeptide
AEREISTTNPVATEQYGQCVCSNWGEHNQENFISETQS

SEQ ID NO: 206079 - protein, 38 aa, Artificial Sequence
  Description of Artificial Sequence: Synthetic polypeptide
CEEEIACTNPVATEQYGSCAAGMGNGDTATGMLMDEAH

SEQ ID NO: 206080 - protein, 40 aa, Artificial Sequence
  Description of Artificial Sequence: Synthetic polypeptide
DEGEIATTNPVAYEPQWGHSIVANAGHALDGARPGDQTNH

SEQ ID NO: 206081 - protein, 39 aa, Artificial Sequence
  Description of Artificial Sequence: Synthetic polypeptide
DEECISTTNPVAYEQYGQCVCSNWGEDHNAEFFNSQTQS

SEQ ID NO: 206082 - protein, 36 aa, Artificial Sequence
  Description of Artificial Sequence: Synthetic polypeptide
QAPEIATTNPVAYEQWGTTSAGTGPAGNPHGDEGMK

SEQ ID NO: 206083 - protein, 36 aa, Artificial Sequence
  Description of Artificial Sequence: Synthetic polypeptide
QAQEIATTNPVAYEQWGSVCAMNNGGEPTIGGGEMW

SEQ ID NO: 206084 - protein, 39 aa, Artificial Sequence
  Description of Artificial Sequence: Synthetic polypeptide
DEECISTTNPVAYEQYGQCVCSNWGEDDNTENFNSDFQS

SEQ ID NO: 206085 - protein, 37 aa, Artificial Sequence
  Description of Artificial Sequence: Synthetic polypeptide
IEGEIVTTNPVAYEQYGEVFCPTPEVGNVTIELEDHI

SEQ ID NO: 206086 - protein, 35 aa, Artificial Sequence
  Description of Artificial Sequence: Synthetic polypeptide
DETEIRTTNPIATECWGATTWAAAEDWAEHEGEYI

SEQ ID NO: 206087 - protein, 39 aa, Artificial Sequence
  Description of Artificial Sequence: Synthetic polypeptide
DEAEISTTNPVATEGYGQCVCSNWGEDHNAENFNSETQI

SEQ ID NO: 206088 - protein, 39 aa, Artificial Sequence
  Description of Artificial Sequence: Synthetic polypeptide
DEECISTTNPVAYEQYGCQVCSNWGEDHNTENFNSETQA

SEQ ID NO: 206089 - protein, 39 aa, Artificial Sequence
  Description of Artificial Sequence: Synthetic polypeptide
DEEEIACTNPVATEMWGCNVVAAATGANHQDNNIMMTNW

SEQ ID NO: 206090 - protein, 35 aa, Artificial Sequence
  Description of Artificial Sequence: Synthetic polypeptide
DEAEIRTTNPIATECWGATTWAWAEDWAEPKGPYI

SEQ ID NO: 206091 - protein, 37 aa, Artificial Sequence
  Description of Artificial Sequence: Synthetic polypeptide
DETEIATTNPVAYAPWGHTACAATAGELPDSAGNPRN

SEQ ID NO: 206092 - protein, 38 aa, Artificial Sequence
  Description of Artificial Sequence: Synthetic polypeptide
DETEIATTNPVAYAPWGHSVSAINTGEPTQGPQDNHSM

SEQ ID NO: 206093 - protein, 36 aa, Artificial Sequence
  Description of Artificial Sequence: Synthetic polypeptide
DETEIATTNPVAYAPWGHSFACAAANGLPQSEQDDS

SEQ ID NO: 206094 - protein, 35 aa, Artificial Sequence
  Description of Artificial Sequence: Synthetic polypeptide
DETGIRTTNPIATECWGATTWANAEDWADPKGPYI

SEQ ID NO: 206095 - protein, 37 aa, Artificial Sequence
  Description of Artificial Sequence: Synthetic polypeptide
DEAEIRTTNPIATEEWGCQTCQNAEDDAENSGSDNIS

SEQ ID NO: 206096 - protein, 37 aa, Artificial Sequence
  Description of Artificial Sequence: Synthetic polypeptide
SEEEVSTTNPVATEGYGCVCSNWGEHDAEYINSDTQS

SEQ ID NO: 206097 - protein, 35 aa, Artificial Sequence
  Description of Artificial Sequence: Synthetic polypeptide
DETHIRTTNPIATECWGATTWANAEDWAEPKGPYI

SEQ ID NO: 206098 - protein, 35 aa, Artificial Sequence
  Description of Artificial Sequence: Synthetic polypeptide
DETIIRTTNPIATECWGATTWANAEDWAEPEGPYI

SEQ ID NO: 206099 - protein, 35 aa, Artificial Sequence
  Description of Artificial Sequence: Synthetic polypeptide
DETIIRTTNPIATECWGATTWANAEDWAEPKGPYI

SEQ ID NO: 206100 - protein, 36 aa, Artificial Sequence
  Description of Artificial Sequence: Synthetic polypeptide
AESEIACTNPVGTEGYGQVSCGSGEHNAEHFGSDQS

SEQ ID NO: 206101 - protein, 37 aa, Artificial Sequence
  Description of Artificial Sequence: Synthetic polypeptide
DENEIATTNPVAYEQWGHCIVAAASGLEDMNPTNDVH

SEQ ID NO: 206102 - protein, 36 aa, Artificial Sequence
  Description of Artificial Sequence: Synthetic polypeptide
AESEIACTNPVGTEGYGVSCGNSGEHNTEHFGSDQS

SEQ ID NO: 206103 - protein, 35 aa, Artificial Sequence
  Description of Artificial Sequence: Synthetic polypeptide
DETLIRTTNPIATECWGATTWANAFDWAEPKGPYI

SEQ ID NO: 206104 - protein, 35 aa, Artificial Sequence
  Description of Artificial Sequence: Synthetic polypeptide
DETLIRTTNPIATECWGATTWANMEDWAEPKGPYI

SEQ ID NO: 206105 - protein, 38 aa, Artificial Sequence
  Description of Artificial Sequence: Synthetic polypeptide
DEASIACTNPVATEQYGSCAAAPGNHPMAGMEIGNDNT

SEQ ID NO: 206106 - protein, 38 aa, Artificial Sequence
  Description of Artificial Sequence: Synthetic polypeptide
ADEEISTTNPVATEGYGCVCSNWGEDHNAENFNSDTQA

SEQ ID NO: 206107 - protein, 37 aa, Artificial Sequence
  Description of Artificial Sequence: Synthetic polypeptide
DEASIACTNPVATEQYGSACPPVGNDLNGAVIDIDAE

SEQ ID NO: 206108 - protein, 37 aa, Artificial Sequence
  Description of Artificial Sequence: Synthetic polypeptide
DEGEIACTNPVATEPYGNCAAATGHGPLDSMGGGMTA

SEQ ID NO: 206109 - protein, 36 aa, Artificial Sequence
  Description of Artificial Sequence: Synthetic polypeptide
AESEIACTNPVGTEGYGVSCGSGEHNQEHFNSDTQS

SEQ ID NO: 206110 - protein, 35 aa, Artificial Sequence
  Description of Artificial Sequence: Synthetic polypeptide
DETNIRTTNPIATECWGATTLANAEDWAEPKGPYI

SEQ ID NO: 206111 - protein, 35 aa, Artificial Sequence
  Description of Artificial Sequence: Synthetic polypeptide
DETNIRTTNPIATECWGATTWANAEDWAEEKGPYI

SEQ ID NO: 206112 - protein, 38 aa, Artificial Sequence
  Description of Artificial Sequence: Synthetic polypeptide
DEDEIASTNPVAYEQWGVACYTGDNLHNDQMTQGQTDD

SEQ ID NO: 206113 - protein, 36 aa, Artificial Sequence
  Description of Artificial Sequence: Synthetic polypeptide
AESEIACTNPVGYEGYGVSCGSMEHNQEHFGSDNQS

SEQ ID NO: 206114 - protein, 35 aa, Artificial Sequence
  Description of Artificial Sequence: Synthetic polypeptide
DETEVATTNPIATEGWGNTTWANNEDWQEPKGPYI

SEQ ID NO: 206115 - protein, 35 aa, Artificial Sequence
  Description of Artificial Sequence: Synthetic polypeptide
DETNIRTTNPIATECWGATTWANAEDWAEPKGPTI

SEQ ID NO: 206116 - protein, 38 aa, Artificial Sequence
  Description of Artificial Sequence: Synthetic polypeptide
ADEEISTTNPVATEGYGCVCSNWGEDHNAENFNSDNQI

SEQ ID NO: 206117 - protein, 37 aa, Artificial Sequence
  Description of Artificial Sequence: Synthetic polypeptide
CEDEIATTNPVAYMQYGSVCSPPPAGGFAHQGDEEAE

SEQ ID NO: 206118 - protein, 38 aa, Artificial Sequence
  Description of Artificial Sequence: Synthetic polypeptide
QAEEIATTNPVATEQYGCVAPGEGGHGLNESAEEANNF

SEQ ID NO: 206119 - protein, 38 aa, Artificial Sequence
  Description of Artificial Sequence: Synthetic polypeptide
QAEEIATTNPVATEQYGCVAPGEGGHGISESGEEADNA

SEQ ID NO: 206120 - protein, 35 aa, Artificial Sequence
  Description of Artificial Sequence: Synthetic polypeptide
DETEIWTTNPIATECWGATTWANAEDGAEEKGPYI

SEQ ID NO: 206121 - protein, 35 aa, Artificial Sequence
  Description of Artificial Sequence: Synthetic polypeptide
DETEIWTTNPIATECWGATTWANAEDWAEPKGPYC

SEQ ID NO: 206122 - protein, 35 aa, Artificial Sequence
  Description of Artificial Sequence: Synthetic polypeptide
DETEIWTTNPIATECWGATTWANAEDWAEPKGPYF

SEQ ID NO: 206123 - protein, 36 aa, Artificial Sequence
  Description of Artificial Sequence: Synthetic polypeptide
GTEAEIATTNPVAYEAWGNICATTDNQDDEDRGTHK

SEQ ID NO: 206124 - protein, 36 aa, Artificial Sequence
  Description of Artificial Sequence: Synthetic polypeptide
GTEAEIATTNPVAYEAWGNICATLDNQGDTDRGTHA

SEQ ID NO: 206125 - protein, 35 aa, Artificial Sequence
  Description of Artificial Sequence: Synthetic polypeptide
DETEIWTTNPIATECWGATTWANAEDWAEPKGPYI

SEQ ID NO: 206126 - protein, 38 aa, Artificial Sequence
  Description of Artificial Sequence: Synthetic polypeptide
QAEEIATTNPVATEQYGCVAPGEGGHGINESANEEEHF

SEQ ID NO: 206127 - protein, 35 aa, Artificial Sequence
  Description of Artificial Sequence: Synthetic polypeptide
DETEIWTTNPIATEPWGATTWANAEDWAEPKGPYI

SEQ ID NO: 206128 - protein, 38 aa, Artificial Sequence
  Description of Artificial Sequence: Synthetic polypeptide
QAEEIATTNPVATEQYGCVAPGEGGHGINESANEEANH

SEQ ID NO: 206129 - protein, 38 aa, Artificial Sequence
  Description of Artificial Sequence: Synthetic polypeptide
QEGEIATTNPVATEQYGNISFSAPDDTDREPHEKEDTV

SEQ ID NO: 206130 - protein, 38 aa, Artificial Sequence
  Description of Artificial Sequence: Synthetic polypeptide
QAEEIATTNPVATEQYGCVAPGEGGHGENESAEEEGMK

SEQ ID NO: 206131 - protein, 38 aa, Artificial Sequence
  Description of Artificial Sequence: Synthetic polypeptide
GSAEIRTTNPVATEQYGVCICPLPNEEQYPEYGEEIHC

SEQ ID NO: 206132 - protein, 35 aa, Artificial Sequence
  Description of Artificial Sequence: Synthetic polypeptide
DETELRTTNPIATECWGATTWANAEDWAEPKGPYI

SEQ ID NO: 206133 - protein, 38 aa, Artificial Sequence
  Description of Artificial Sequence: Synthetic polypeptide
DETEIATTNPVAYEQWGSIICPAVADAGTDHQWDTMEH

SEQ ID NO: 206134 - protein, 39 aa, Artificial Sequence
  Description of Artificial Sequence: Synthetic polypeptide
DEECISTTNPVAYEGYGQCVCQNSMEDHNTENFISDNQA

SEQ ID NO: 206135 - protein, 36 aa, Artificial Sequence
  Description of Artificial Sequence: Synthetic polypeptide
DEQEIATTNPVAYEQWGPCTAGNNNLTEATPDDKPY

SEQ ID NO: 206136 - protein, 39 aa, Artificial Sequence
  Description of Artificial Sequence: Synthetic polypeptide
QEGEIATTNPVATEQYGNISFPAPFDTLWEPHEGLEDTR

SEQ ID NO: 206137 - protein, 39 aa, Artificial Sequence
  Description of Artificial Sequence: Synthetic polypeptide
QEGEIATTNPVATEQYGNISFHAPFDTLREPHEGLQDTR

SEQ ID NO: 206138 - protein, 38 aa, Artificial Sequence
  Description of Artificial Sequence: Synthetic polypeptide
QEGEIATTNPVATEQYGNISFDAPDDTGREPHEKEDTR

SEQ ID NO: 206139 - protein, 39 aa, Artificial Sequence
  Description of Artificial Sequence: Synthetic polypeptide
DEAEISTTNPVATEQYGQCVCQNWGEDHNAENFNSDTQG

SEQ ID NO: 206140 - protein, 36 aa, Artificial Sequence
  Description of Artificial Sequence: Synthetic polypeptide
DEMAIGTTNPVATEQYGVLQTATDGSPVEFETSDKQ

SEQ ID NO: 206141 - protein, 35 aa, Artificial Sequence
  Description of Artificial Sequence: Synthetic polypeptide
DETELRTTNPIATECWGATTWANAEDWFEPKGPYQ

SEQ ID NO: 206142 - protein, 36 aa, Artificial Sequence
  Description of Artificial Sequence: Synthetic polypeptide
DEMAIITTNPVATEQYGCCLCTATDGSPVEFETDKQ

SEQ ID NO: 206143 - protein, 35 aa, Artificial Sequence
  Description of Artificial Sequence: Synthetic polypeptide
DETEVATTNPIATEGWGNTTWAANEDWQEPKGPYI

SEQ ID NO: 206144 - protein, 34 aa, Artificial Sequence
  Description of Artificial Sequence: Synthetic polypeptide
AESEIASTNPVGTEAWGVCAPTERDQHQGQDDQE

SEQ ID NO: 206145 - protein, 35 aa, Artificial Sequence
  Description of Artificial Sequence: Synthetic polypeptide
DETNIRTTNPIATECWGATTWANAEDWAEPKGPYI

SEQ ID NO: 206146 - protein, 36 aa, Artificial Sequence
  Description of Artificial Sequence: Synthetic polypeptide
QEEEIATTNPVAYEPYGEHAPWCEWHEFSQHAEGES

SEQ ID NO: 206147 - protein, 38 aa, Artificial Sequence
  Description of Artificial Sequence: Synthetic polypeptide
SEEEISTTNPVAYEGYGQCVCSNWGEHNAENFNSDTQS

SEQ ID NO: 206148 - protein, 38 aa, Artificial Sequence
  Description of Artificial Sequence: Synthetic polypeptide
SEEEISTTNPVAYEGYGQCVCSNWGEDNAEHFGSDTQA

SEQ ID NO: 206149 - protein, 38 aa, Artificial Sequence
  Description of Artificial Sequence: Synthetic polypeptide
DESEIRTTNPVATCGYGCVCSNWMEDHNQENFTSDTQA

SEQ ID NO: 206150 - protein, 37 aa, Artificial Sequence
  Description of Artificial Sequence: Synthetic polypeptide
DENEIRTTNPVSYEGYGCICSNWEEHNAEYFGSDTQG

SEQ ID NO: 206151 - protein, 38 aa, Artificial Sequence
  Description of Artificial Sequence: Synthetic polypeptide
SEEEISTTNPVAYEGYGCVCSNWGEDHNTENFNSETQA

SEQ ID NO: 206152 - protein, 38 aa, Artificial Sequence
  Description of Artificial Sequence: Synthetic polypeptide
SEEEISTTNPVAYEGYGCVCSNWGEDHNAEYFNSDTQS

SEQ ID NO: 206153 - protein, 37 aa, Artificial Sequence
  Description of Artificial Sequence: Synthetic polypeptide
DENEIRTTNPVSYEGYGCICSNWEEPNQEYFGSDTQA

SEQ ID NO: 206154 - protein, 37 aa, Artificial Sequence
  Description of Artificial Sequence: Synthetic polypeptide
QEEEIATTNPVAYEQYGEHAPRCEHEFSQHAEGEQWQ

SEQ ID NO: 206155 - protein, 36 aa, Artificial Sequence
  Description of Artificial Sequence: Synthetic polypeptide
DENEIRTTNPIATECWGATTWANAEDWAAEPKGPYI

SEQ ID NO: 206156 - protein, 38 aa, Artificial Sequence
  Description of Artificial Sequence: Synthetic polypeptide
SEEEISTTNPVAYEEYGQCVCSNWGEHNAENFNSDTQP

SEQ ID NO: 206157 - protein, 35 aa, Artificial Sequence
  Description of Artificial Sequence: Synthetic polypeptide
DETVIRTTNPIATECWGAGTWANAEDWAEPKGAYI

SEQ ID NO: 206158 - protein, 35 aa, Artificial Sequence
  Description of Artificial Sequence: Synthetic polypeptide
DENEIRTTNPIATECWGATTWANAEDWEEPMIPYA

SEQ ID NO: 206159 - protein, 35 aa, Artificial Sequence
  Description of Artificial Sequence: Synthetic polypeptide
DETVIRTTNPIATECWGATTWANAEDWAEMKGPYI

SEQ ID NO: 206160 - protein, 35 aa, Artificial Sequence
  Description of Artificial Sequence: Synthetic polypeptide
DETVIRTTNPIATECWGATTWANAEDWAEPKGKYI

SEQ ID NO: 206161 - protein, 35 aa, Artificial Sequence
  Description of Artificial Sequence: Synthetic polypeptide
DETVIRTTNPIATECWGATTWANAEDWAEPKGPSI

SEQ ID NO: 206162 - protein, 40 aa, Artificial Sequence
  Description of Artificial Sequence: Synthetic polypeptide
SEEEISTTNPVATEQYGQCVVCSNWGEDHNQENFISENQS

SEQ ID NO: 206163 - protein, 39 aa, Artificial Sequence
  Description of Artificial Sequence: Synthetic polypeptide
SEEEISTTNPVATEQYGQCVCYNWGEDHNAENFNSDNQG

SEQ ID NO: 206164 - protein, 35 aa, Artificial Sequence
  Description of Artificial Sequence: Synthetic polypeptide
DETVIRTTNPIATECWGATTWANAEDWAEPYGPYI

SEQ ID NO: 206165 - protein, 36 aa, Artificial Sequence
  Description of Artificial Sequence: Synthetic polypeptide
AESEIASTNPVGTEGYGQCSCGSGEDNQEHFGSDQS

SEQ ID NO: 206166 - protein, 39 aa, Artificial Sequence
  Description of Artificial Sequence: Synthetic polypeptide
SEEEISTTNPVATEQYGQCVCSNWGEDHNQENFISEPQS

SEQ ID NO: 206167 - protein, 35 aa, Artificial Sequence
  Description of Artificial Sequence: Synthetic polypeptide
DETVIRTTNPIATECWGATTWANAEDWAPPKGPYI

SEQ ID NO: 206168 - protein, 37 aa, Artificial Sequence
  Description of Artificial Sequence: Synthetic polypeptide
MENCIRTTNPVATEQYGTCQPWPPTNEDETESDQTTA

SEQ ID NO: 206169 - protein, 39 aa, Artificial Sequence
  Description of Artificial Sequence: Synthetic polypeptide
SEEEISTTNPVATEQYGQCVCGNWGEDHNAENFNSDTQS

SEQ ID NO: 206170 - protein, 39 aa, Artificial Sequence
  Description of Artificial Sequence: Synthetic polypeptide
SEEEISTTNPVATEQYGQCVCGNWGEDDNAENFNSETQS

SEQ ID NO: 206171 - protein, 40 aa, Artificial Sequence
  Description of Artificial Sequence: Synthetic polypeptide
SEEEISTTNPVATEQYGQCQVCSNWGEDHNAENFNSDNQL

SEQ ID NO: 206172 - protein, 38 aa, Artificial Sequence
  Description of Artificial Sequence: Synthetic polypeptide
DENEIRTTNPVSYEGYGCICSNWEEDDNAESFGSDNQS

SEQ ID NO: 206173 - protein, 39 aa, Artificial Sequence
  Description of Artificial Sequence: Synthetic polypeptide
SEEEISTTNPVAYEGYGQCVCSTWGEDHNAENFNSENQS

SEQ ID NO: 206174 - protein, 36 aa, Artificial Sequence
  Description of Artificial Sequence: Synthetic polypeptide
DAEEIATTNPVAYAQWGCNTAGNNGLTTAETGGLDS

SEQ ID NO: 206175 - protein, 39 aa, Artificial Sequence
  Description of Artificial Sequence: Synthetic polypeptide
SEEEISTTNPVAYEGYGQCVCSTWGEDHNAENFNSETQA

SEQ ID NO: 206176 - protein, 38 aa, Artificial Sequence
  Description of Artificial Sequence: Synthetic polypeptide
ADEEISTTNPVATEGYGCVCSNWGEDHNAENFNSDTQS

SEQ ID NO: 206177 - protein, 35 aa, Artificial Sequence
  Description of Artificial Sequence: Synthetic polypeptide
DETPIRTTNPIATECWGAHTWANAEDWAEPKGPYI

SEQ ID NO: 206178 - protein, 35 aa, Artificial Sequence
  Description of Artificial Sequence: Synthetic polypeptide
DETPIRTTNPIATECWGATTWANAEDWAEPKGPYI

SEQ ID NO: 206179 - protein, 35 aa, Artificial Sequence
  Description of Artificial Sequence: Synthetic polypeptide
DETPIRTTNPIATECWGTTTWANAEDWAEPKGPYI

SEQ ID NO: 206180 - protein, 35 aa, Artificial Sequence
  Description of Artificial Sequence: Synthetic polypeptide
DETQIRTTNPIATECWGATTWANAEDWAEGKGPYI

SEQ ID NO: 206181 - protein, 38 aa, Artificial Sequence
  Description of Artificial Sequence: Synthetic polypeptide
QAEEIATTNPVATEQYGCVANPGEGGHGQNESAEEANM

SEQ ID NO: 206182 - protein, 37 aa, Artificial Sequence
  Description of Artificial Sequence: Synthetic polypeptide
DEGEIACTNPVATAQWGHVVAANTGAGEYGAEGDGNT

SEQ ID NO: 206183 - protein, 38 aa, Artificial Sequence
  Description of Artificial Sequence: Synthetic polypeptide
QAEEIATTNPVATEQYGCVANPGEGGHGQNESAEEAKV

SEQ ID NO: 206184 - protein, 35 aa, Artificial Sequence
  Description of Artificial Sequence: Synthetic polypeptide
DETSIRTTNPIATECWGATTWANAEDWAEPKGPYI

SEQ ID NO: 206185 - protein, 40 aa, Artificial Sequence
  Description of Artificial Sequence: Synthetic polypeptide
MEGEIRTTNPVATEQYGTSYIREAMSWDYMTTEESNQQEG

SEQ ID NO: 206186 - protein, 38 aa, Artificial Sequence
  Description of Artificial Sequence: Synthetic polypeptide
ADEEISTTNPVATEGYGQCVCSNWGEHNAEHFNSDTQS

SEQ ID NO: 206187 - protein, 35 aa, Artificial Sequence
  Description of Artificial Sequence: Synthetic polypeptide
DETTIRTTNPIATECWGATTWNNAEDWAEPKGPYI

SEQ ID NO: 206188 - protein, 36 aa, Artificial Sequence
  Description of Artificial Sequence: Synthetic polypeptide
GTEAEIATTNPVAYEAWGNICATTDNQGDEDRNNHQ

SEQ ID NO: 206189 - protein, 37 aa, Artificial Sequence
  Description of Artificial Sequence: Synthetic polypeptide
FETMIKTTNPDATENFWGTMAESLCSNLWQREQQNTE

SEQ ID NO: 206190 - protein, 39 aa, Artificial Sequence
  Description of Artificial Sequence: Synthetic polypeptide
MEGEIRTTNPVATEWYGCSCSYPAPEEGPNMVFEGESDC

SEQ ID NO: 206191 - protein, 35 aa, Artificial Sequence
  Description of Artificial Sequence: Synthetic polypeptide
DETVIASTNPVAYEQWGCVAACTVPPSDMPPGQEP

SEQ ID NO: 206192 - protein, 38 aa, Artificial Sequence
  Description of Artificial Sequence: Synthetic polypeptide
DESCIRTTNPVATEGWGQCVCSNWGEENQEYFGSDTQA

SEQ ID NO: 206193 - protein, 39 aa, Artificial Sequence
  Description of Artificial Sequence: Synthetic polypeptide
SEEEISTTNPVAYEQYGQCVCSNWGEDPNQENFNSDNQN

SEQ ID NO: 206194 - protein, 39 aa, Artificial Sequence
  Description of Artificial Sequence: Synthetic polypeptide
MEGEIRTTNPVATEWYGWCCSSPAPEEGPNMVFEGNSDC

SEQ ID NO: 206195 - protein, 39 aa, Artificial Sequence
  Description of Artificial Sequence: Synthetic polypeptide
SEEEISTTNPVAYEQYGQCVCSNWGEDHNAESFNSDTQA

SEQ ID NO: 206196 - protein, 39 aa, Artificial Sequence
  Description of Artificial Sequence: Synthetic polypeptide
SEEEISTTNPVAYEQYGQCVCSNWGEDHNAENFNSDTQG

SEQ ID NO: 206197 - protein, 39 aa, Artificial Sequence
  Description of Artificial Sequence: Synthetic polypeptide
SEEEISTTNPVAYEQYGQCVCSNWGEDHNAENFNSDTQA

SEQ ID NO: 206198 - protein, 39 aa, Artificial Sequence
  Description of Artificial Sequence: Synthetic polypeptide
SEEEISTTNPVAYEQYGQCVCSNWGEDHNAENFISENQA

SEQ ID NO: 206199 - protein, 39 aa, Artificial Sequence
  Description of Artificial Sequence: Synthetic polypeptide
SEEEISTTNPVAYEQYGQCVCSNWGEDHNAEHFNSDTQA

SEQ ID NO: 206200 - protein, 39 aa, Artificial Sequence
  Description of Artificial Sequence: Synthetic polypeptide
SEEEISTTNPVAYEQYGQCVCSNWGEDDNAEYFNSDTQM

SEQ ID NO: 206201 - protein, 38 aa, Artificial Sequence
  Description of Artificial Sequence: Synthetic polypeptide
DEQEIATTNPVAYEQWGSIICPAVAHAGTDHQGDSMEA

SEQ ID NO: 206202 - protein, 39 aa, Artificial Sequence
  Description of Artificial Sequence: Synthetic polypeptide
ADEEISTTNPVATEGYGQCVCSTWGEDHNAENFNSDTAS

SEQ ID NO: 206203 - protein, 36 aa, Artificial Sequence
  Description of Artificial Sequence: Synthetic polypeptide
GTEAEIATTNPVAYEAWGNICATTDNQGDEQRDMHQ

SEQ ID NO: 206204 - protein, 35 aa, Artificial Sequence
  Description of Artificial Sequence: Synthetic polypeptide
GTEAEIATTNPVAYEAWGNICATTDNQGDMDKGTH

SEQ ID NO: 206205 - protein, 36 aa, Artificial Sequence
  Description of Artificial Sequence: Synthetic polypeptide
GTEAEIATTNPVAYEAWGNICATTDNQGDTDRDNEH

SEQ ID NO: 206206 - protein, 35 aa, Artificial Sequence
  Description of Artificial Sequence: Synthetic polypeptide
SEMEIACTNPCSYEQYGCVCSTWGEDAESFGSDQS

SEQ ID NO: 206207 - protein, 35 aa, Artificial Sequence
  Description of Artificial Sequence: Synthetic polypeptide
DETEIRHTNPIATECWGATTWANAEDWAEPKNPYI

SEQ ID NO: 206208 - protein, 39 aa, Artificial Sequence
  Description of Artificial Sequence: Synthetic polypeptide
DETEIRGTNPVATEFYGTVVMQDTFTQDNVDTGGFGQGG

SEQ ID NO: 206209 - protein, 37 aa, Artificial Sequence
  Description of Artificial Sequence: Synthetic polypeptide
DEQEIATTNPVAYEQWGHCIIAGNSGLVDNDGGEEDA

SEQ ID NO: 206210 - protein, 37 aa, Artificial Sequence
  Description of Artificial Sequence: Synthetic polypeptide
SEMEIACTNPCSYEQYGCVCSNWGNLNQENFGSDTQA

SEQ ID NO: 206211 - protein, 36 aa, Artificial Sequence
  Description of Artificial Sequence: Synthetic polypeptide
SEMEIACTNPCSYEQYGCVCSNWGNDQESFGSDTQS

SEQ ID NO: 206212 - protein, 37 aa, Artificial Sequence
  Description of Artificial Sequence: Synthetic polypeptide
DEQEIATTNPVAYEQWGHCIIFAGNDGLVDNDLNDAD

SEQ ID NO: 206213 - protein, 35 aa, Artificial Sequence
  Description of Artificial Sequence: Synthetic polypeptide
SEMEIACTNPCSYEQYGCVCSNWGEHNQSFNSDQA

SEQ ID NO: 206214 - protein, 38 aa, Artificial Sequence
  Description of Artificial Sequence: Synthetic polypeptide
DEQEIATTNPVAYEQWGHCIIFAGNSGLVDNDAGENDA

SEQ ID NO: 206215 - protein, 35 aa, Artificial Sequence
  Description of Artificial Sequence: Synthetic polypeptide
SEMEIACTNPCSYEQYGCVCSNWGEDNISFGSDQS

SEQ ID NO: 206216 - protein, 38 aa, Artificial Sequence
  Description of Artificial Sequence: Synthetic polypeptide
DEQEIATTNPVAYEQWGHCIIFAGNSGLVDNDGENDEQ

SEQ ID NO: 206217 - protein, 34 aa, Artificial Sequence
  Description of Artificial Sequence: Synthetic polypeptide
AESEIAATNPVGTEAWGVCAPTDRDQHQGQHDMD

SEQ ID NO: 206218 - protein, 38 aa, Artificial Sequence
  Description of Artificial Sequence: Synthetic polypeptide
QAEEIATTNPVATEQYGCVAPGEGGHGQNESAEEANKT

SEQ ID NO: 206219 - protein, 36 aa, Artificial Sequence
  Description of Artificial Sequence: Synthetic polypeptide
SEMEIACTNPCSYEQYGCVCSMWEDNAESFGSDNQS

SEQ ID NO: 206220 - protein, 35 aa, Artificial Sequence
  Description of Artificial Sequence: Synthetic polypeptide
DECEIRTTNPIATECWGATTWANAEDWAEPKEPYI

SEQ ID NO: 206221 - protein, 34 aa, Artificial Sequence
  Description of Artificial Sequence: Synthetic polypeptide
SEMEIACTNPCSYEGYGCVCSWGEDNQSFGSEQS

SEQ ID NO: 206222 - protein, 36 aa, Artificial Sequence
  Description of Artificial Sequence: Synthetic polypeptide
DECEIRTTNPIATECWGATTWANAEDEWAEPKGPYI

SEQ ID NO: 206223 - protein, 37 aa, Artificial Sequence
  Description of Artificial Sequence: Synthetic polypeptide
DEQEIATTNPVAYEQWGHCIIFAGNSGLVDNDSNNAW

SEQ ID NO: 206224 - protein, 37 aa, Artificial Sequence
  Description of Artificial Sequence: Synthetic polypeptide
DEQEIATTNPVAYEQWGHCIIFAGNSGLVDNSSNDAP

SEQ ID NO: 206225 - protein, 38 aa, Artificial Sequence
  Description of Artificial Sequence: Synthetic polypeptide
DEQEIATTNPVAYEQWGHCINAAASGLEDGMNPTGDRH

SEQ ID NO: 206226 - protein, 35 aa, Artificial Sequence
  Description of Artificial Sequence: Synthetic polypeptide
DETEIRCTNPIATECWGATTWANAEDWAEPKGPYI

SEQ ID NO: 206227 - protein, 39 aa, Artificial Sequence
  Description of Artificial Sequence: Synthetic polypeptide
SEMCISTTNPVATEQYGQCVTSTWGADDNAEYFGSDPQS

SEQ ID NO: 206228 - protein, 37 aa, Artificial Sequence
  Description of Artificial Sequence: Synthetic polypeptide
DEQEIATTNPVAYEQWGHCIVAAASGLEDMNPTEDEH

SEQ ID NO: 206229 - protein, 35 aa, Artificial Sequence
  Description of Artificial Sequence: Synthetic polypeptide
DETEIRCTNPCATECWGATTWFNAEDWEEPQEPQI

SEQ ID NO: 206230 - protein, 38 aa, Artificial Sequence
  Description of Artificial Sequence: Synthetic polypeptide
DEQEIATTNPVAYEQWGHCIVAAASGLEDNMNPTGDVH

SEQ ID NO: 206231 - protein, 35 aa, Artificial Sequence
  Description of Artificial Sequence: Synthetic polypeptide
DETEIRQTNPIATECWGATTWANAEDKAEPKGPYI

SEQ ID NO: 206232 - protein, 35 aa, Artificial Sequence
  Description of Artificial Sequence: Synthetic polypeptide
DETEIRQTNPIATECWGATTWANAEDWAEPKGPYI

SEQ ID NO: 206233 - protein, 35 aa, Artificial Sequence
  Description of Artificial Sequence: Synthetic polypeptide
DETEIRQTNPIATECWGATTWANDEDWAEPTGPYI

SEQ ID NO: 206234 - protein, 35 aa, Artificial Sequence
  Description of Artificial Sequence: Synthetic polypeptide
DETEIRQTNPIATECWGITTWANAEDWAEPKGPYI

SEQ ID NO: 206235 - protein, 36 aa, Artificial Sequence
  Description of Artificial Sequence: Synthetic polypeptide
SEMEIACTNPVGYEGYGCSCGSGEHNQEHFGSDNQS

SEQ ID NO: 206236 - protein, 39 aa, Artificial Sequence
  Description of Artificial Sequence: Synthetic polypeptide
DEAEISTTNPVATEGYGQCVCSNWGEDHNIENFGSEFQG

SEQ ID NO: 206237 - protein, 39 aa, Artificial Sequence
  Description of Artificial Sequence: Synthetic polypeptide
DEAEISTTNPVATEGYGQCVCSNWGEDHNIENFNSDTQA

SEQ ID NO: 206238 - protein, 35 aa, Artificial Sequence
  Description of Artificial Sequence: Synthetic polypeptide
SEMEIACTNPCSYEQYGQCVCSWGEDNQSFGSQQA

SEQ ID NO: 206239 - protein, 36 aa, Artificial Sequence
  Description of Artificial Sequence: Synthetic polypeptide
DEQEIATTNPVAYEPQWGCIAGPAGALNGAPLGEPW

SEQ ID NO: 206240 - protein, 35 aa, Artificial Sequence
  Description of Artificial Sequence: Synthetic polypeptide
SEMEIACTNPCSYEQYGQCVCSWEDNQESFGSDQN

SEQ ID NO: 206241 - protein, 39 aa, Artificial Sequence
  Description of Artificial Sequence: Synthetic polypeptide
MEGEIRTTNPVATEQYGSIMNMWPMPHDTGQDSGQYTTG

SEQ ID NO: 206242 - protein, 38 aa, Artificial Sequence
  Description of Artificial Sequence: Synthetic polypeptide
AEEEIRTTNPCATEGYGCCCSNWGEDDNAENFNSDTQA

SEQ ID NO: 206243 - protein, 35 aa, Artificial Sequence
  Description of Artificial Sequence: Synthetic polypeptide
SEMEIACTNPCSYEQYGCVCSWMEDHNQSFGSDQS

SEQ ID NO: 206244 - protein, 34 aa, Artificial Sequence
  Description of Artificial Sequence: Synthetic polypeptide
SEMEIACTNPCSYEQYGCVCSWGEHNQSFSSDQM

SEQ ID NO: 206245 - protein, 35 aa, Artificial Sequence
  Description of Artificial Sequence: Synthetic polypeptide
SEMEIACTNPCSYEQYGCVCSWGEHNQSFGSDFQS

SEQ ID NO: 206246 - protein, 35 aa, Artificial Sequence
  Description of Artificial Sequence: Synthetic polypeptide
SEMEIACTNPCSYEQYGCVCSWGEHNASFGSDTQI

SEQ ID NO: 206247 - protein, 38 aa, Artificial Sequence
  Description of Artificial Sequence: Synthetic polypeptide
DEQEIATTNPVAYEQWGHCIVAAASGLEDTMNPMEDRH

SEQ ID NO: 206248 - protein, 36 aa, Artificial Sequence
  Description of Artificial Sequence: Synthetic polypeptide
SEMEIACTNPCSYEQYGCVCSWGEGDNQSFGSDNQS

SEQ ID NO: 206249 - protein, 34 aa, Artificial Sequence
  Description of Artificial Sequence: Synthetic polypeptide
SEMEIACTNPCSYEQYGCVCSWGEDQESFISDQS

SEQ ID NO: 206250 - protein, 35 aa, Artificial Sequence
  Description of Artificial Sequence: Synthetic polypeptide
SEMEIACTNPCSYEQYGCVCSWGEDDQSFGSDTQS

SEQ ID NO: 206251 - protein, 36 aa, Artificial Sequence
  Description of Artificial Sequence: Synthetic polypeptide
DEQEIATTNPVAYEQWGCTAGNNAGTQATPDDKMTI

SEQ ID NO: 206252 - protein, 38 aa, Artificial Sequence
  Description of Artificial Sequence: Synthetic polypeptide
DEECISTTNPVAYEQWGVAYYIEINTNDQNPNSGHGGQ

SEQ ID NO: 206253 - protein, 35 aa, Artificial Sequence
  Description of Artificial Sequence: Synthetic polypeptide
SEMEIACTNPCSYEQYGCVCSWEEPNQSFGSDTQS

SEQ ID NO: 206254 - protein, 39 aa, Artificial Sequence
  Description of Artificial Sequence: Synthetic polypeptide
DETEIRSTNPVATDFYGVVNDNSIGQNGGQTEDNDDTDG

SEQ ID NO: 206255 - protein, 35 aa, Artificial Sequence
  Description of Artificial Sequence: Synthetic polypeptide
DETEIRSTNPIATECWGATTWANAEDWAEPKGPYQ

SEQ ID NO: 206256 - protein, 35 aa, Artificial Sequence
  Description of Artificial Sequence: Synthetic polypeptide
DETEIRSTNPIATECWGATTWANAEDWAEPKGPYI

SEQ ID NO: 206257 - protein, 35 aa, Artificial Sequence
  Description of Artificial Sequence: Synthetic polypeptide
DETEIRSTNPIATECWGATTWANAEDIAEPKGPYI

SEQ ID NO: 206258 - protein, 38 aa, Artificial Sequence
  Description of Artificial Sequence: Synthetic polypeptide
AEEEIRCTNPVAYEQYGQCVCSNWGEDNDEYFISDTQS

SEQ ID NO: 206259 - protein, 39 aa, Artificial Sequence
  Description of Artificial Sequence: Synthetic polypeptide
AEEEIRCTNPVAYEQYGQCVCSNWGEDHNAENFNSDNQL

SEQ ID NO: 206260 - protein, 37 aa, Artificial Sequence
  Description of Artificial Sequence: Synthetic polypeptide
SEMEIACTNPCSYEQYGCVCSTWGEDNIESFGSDNQS

SEQ ID NO: 206261 - protein, 35 aa, Artificial Sequence
  Description of Artificial Sequence: Synthetic polypeptide
SEMEIACTNPCSYEQYGCVCSWGEEHNASFGSDQA

SEQ ID NO: 206262 - protein, 39 aa, Artificial Sequence
  Description of Artificial Sequence: Synthetic polypeptide
DEAEISTTNPVATEGYGQCVCSNWGEDHNAESFNSDTQS

SEQ ID NO: 206263 - protein, 36 aa, Artificial Sequence
  Description of Artificial Sequence: Synthetic polypeptide
DETEIRATNPIATECWGMATTWANAEDWAEPKGPYI

SEQ ID NO: 206264 - protein, 35 aa, Artificial Sequence
  Description of Artificial Sequence: Synthetic polypeptide
DETEIRATNPIATECWGATTWANAEDWAEPKGPYI

SEQ ID NO: 206265 - protein, 36 aa, Artificial Sequence
  Description of Artificial Sequence: Synthetic polypeptide
QEGEIATTNPVAYEQYGEHAPWCEHEFSQHAEGEWY

SEQ ID NO: 206266 - protein, 38 aa, Artificial Sequence
  Description of Artificial Sequence: Synthetic polypeptide
QEGEIATTNPVATYQYGNISFSAPDDTAREPHEKEDTR

SEQ ID NO: 206267 - protein, 37 aa, Artificial Sequence
  Description of Artificial Sequence: Synthetic polypeptide
ADEEISCTNPVATEQYGCVCSMWGEDNAEGFISDTQA

SEQ ID NO: 206268 - protein, 36 aa, Artificial Sequence
  Description of Artificial Sequence: Synthetic polypeptide
QEEEIATTNPVAYEAYGEHAPWCEGEFSQSHAEGEV

SEQ ID NO: 206269 - protein, 36 aa, Artificial Sequence
  Description of Artificial Sequence: Synthetic polypeptide
DEMAIGTTNPVATEQYGCLFEATQGSPVEFETSDKQ

SEQ ID NO: 206270 - protein, 38 aa, Artificial Sequence
  Description of Artificial Sequence: Synthetic polypeptide
ADEEISCTNPVATEQYGCVCSNWGEDHNAENFNSDFQS

SEQ ID NO: 206271 - protein, 35 aa, Artificial Sequence
  Description of Artificial Sequence: Synthetic polypeptide
DETEIVTTNPIATECWGATTWANAEDWAEPKGPYI

SEQ ID NO: 206272 - protein, 36 aa, Artificial Sequence
  Description of Artificial Sequence: Synthetic polypeptide
QEEEIATTNPVAYEAYGEHAPWCEHEFSQVHAEGEP

SEQ ID NO: 206273 - protein, 35 aa, Artificial Sequence
  Description of Artificial Sequence: Synthetic polypeptide
DETEIVTTNPIATECWGATTWANAEDWNEPKGPYI

SEQ ID NO: 206274 - protein, 36 aa, Artificial Sequence
  Description of Artificial Sequence: Synthetic polypeptide
QEEEIATTNPVAYEAYGEHNPWCEHEFSQSHAEGKW

SEQ ID NO: 206275 - protein, 36 aa, Artificial Sequence
  Description of Artificial Sequence: Synthetic polypeptide
QEEEIATTNPVAYEAYGEHYPWCEHAFSQSHAEGEW

SEQ ID NO: 206276 - protein, 35 aa, Artificial Sequence
  Description of Artificial Sequence: Synthetic polypeptide
DETEICTTNPIATECWGATTWANAEDWAEPKGPYI

SEQ ID NO: 206277 - protein, 33 aa, Artificial Sequence
  Description of Artificial Sequence: Synthetic polypeptide
DESEIASTNPIGTEGWGATWANSDWAEPKGPYI

SEQ ID NO: 206278 - protein, 38 aa, Artificial Sequence
  Description of Artificial Sequence: Synthetic polypeptide
QAEEIATTNPVATEQYGCVAPGEGGHGPNESAEEAFNQ

SEQ ID NO: 206279 - protein, 36 aa, Artificial Sequence
  Description of Artificial Sequence: Synthetic polypeptide
DETEIATTNPVGYEQWGHSACAAANPLAAAPIEDHQ

SEQ ID NO: 206280 - protein, 37 aa, Artificial Sequence
  Description of Artificial Sequence: Synthetic polypeptide
DEMAIGTTNPVATEQYGCLHQATDGSPVEFETSDQKQ

SEQ ID NO: 206281 - protein, 36 aa, Artificial Sequence
  Description of Artificial Sequence: Synthetic polypeptide
DETEIATTNPVAYYAPWGHSACAAANGLQSEPQDDE

SEQ ID NO: 206282 - protein, 39 aa, Artificial Sequence
  Description of Artificial Sequence: Synthetic polypeptide
DDEEIRTTNPVATEGYGICVCSNWVEDDNAENFISDTQS

SEQ ID NO: 206283 - protein, 36 aa, Artificial Sequence
  Description of Artificial Sequence: Synthetic polypeptide
QEEEIATTNPVAYEHYGEHAPWCEHEFSHSHEEGEW

SEQ ID NO: 206284 - protein, 38 aa, Artificial Sequence
  Description of Artificial Sequence: Synthetic polypeptide
DEECISTTNPVAYEGYGQCVCSNSGEHNAENFNSDTQA

SEQ ID NO: 206285 - protein, 36 aa, Artificial Sequence
  Description of Artificial Sequence: Synthetic polypeptide
HEDEIASVNPVCYEPYGIVTVNTIQNLSTAAGGNNV

SEQ ID NO: 206286 - protein, 38 aa, Artificial Sequence
  Description of Artificial Sequence: Synthetic polypeptide
GTENEIATTNPVAYEQWGCVYNNVVRPEDVQAGKNGAS

SEQ ID NO: 206287 - protein, 37 aa, Artificial Sequence
  Description of Artificial Sequence: Synthetic polypeptide
DEQEIATTNPVAYEQWGHCWIFAGNSGLVDNDSNDAE

SEQ ID NO: 206288 - protein, 37 aa, Artificial Sequence
  Description of Artificial Sequence: Synthetic polypeptide
GTEAEIATTNPVAYEAWGNICATTDNQGDTDRGNHHN

SEQ ID NO: 206289 - protein, 36 aa, Artificial Sequence
  Description of Artificial Sequence: Synthetic polypeptide
GTEAEIATTNPVAYEAWGNICATTDNQGDTDRGDHK

SEQ ID NO: 206290 - protein, 38 aa, Artificial Sequence
  Description of Artificial Sequence: Synthetic polypeptide
QEGEIATTNPVCTEIYGNISASAPDDTLREPHEGEDTR

SEQ ID NO: 206291 - protein, 35 aa, Artificial Sequence
  Description of Artificial Sequence: Synthetic polypeptide
DETEISTTNPIATECWGATTWLNAEDWAEPKGPYI

SEQ ID NO: 206292 - protein, 35 aa, Artificial Sequence
  Description of Artificial Sequence: Synthetic polypeptide
DETEISTTNPIATECWGATTWANWEDWAEPKGPYI

SEQ ID NO: 206293 - protein, 38 aa, Artificial Sequence
  Description of Artificial Sequence: Synthetic polypeptide
ADEEISCTNPVATEQYGCVCSMWGEDHNAENFNSDTQA

SEQ ID NO: 206294 - protein, 35 aa, Artificial Sequence
  Description of Artificial Sequence: Synthetic polypeptide
DETEIRATNPIATECWGATTWANAEDWAEPKGPQI

SEQ ID NO: 206295 - protein, 35 aa, Artificial Sequence
  Description of Artificial Sequence: Synthetic polypeptide
DETEIRATNPIATECWGATTWANAEDWAEPKGPLI

SEQ ID NO: 206296 - protein, 35 aa, Artificial Sequence
  Description of Artificial Sequence: Synthetic polypeptide
DETEIRATNPIATECWGATTWANAEDWAEPKGPAI

SEQ ID NO: 206297 - protein, 35 aa, Artificial Sequence
  Description of Artificial Sequence: Synthetic polypeptide
DETEIRATNPIATECWGATTWANAEDTAEPKGPYI

SEQ ID NO: 206298 - protein, 39 aa, Artificial Sequence
  Description of Artificial Sequence: Synthetic polypeptide
DEECISTTNPVAYEGYGQCVCSTSGEDHNAENFNSDTQS

SEQ ID NO: 206299 - protein, 35 aa, Artificial Sequence
  Description of Artificial Sequence: Synthetic polypeptide
DETEIRTVNPIATECWGATTWANAEDWAEPKGPYI

SEQ ID NO: 206300 - protein, 35 aa, Artificial Sequence
  Description of Artificial Sequence: Synthetic polypeptide
DETEIQTTNPIATECWGATTWANANDWAEPKGPYI

SEQ ID NO: 206301 - protein, 35 aa, Artificial Sequence
  Description of Artificial Sequence: Synthetic polypeptide
DETEIQTTNPIATECWGATTWANAEDWAEPKGPYI

SEQ ID NO: 206302 - protein, 35 aa, Artificial Sequence
  Description of Artificial Sequence: Synthetic polypeptide
DETEIRTVNPIATECWGATTWFNAEDWAEPKGPYI

SEQ ID NO: 206303 - protein, 35 aa, Artificial Sequence
  Description of Artificial Sequence: Synthetic polypeptide
DETEISTTNPCATECWGATTWANAEDWPEPKGPYI

SEQ ID NO: 206304 - protein, 35 aa, Artificial Sequence
  Description of Artificial Sequence: Synthetic polypeptide
DETEINTTNPIATECWGATTWANAEDWAEPKGPYI

SEQ ID NO: 206305 - protein, 35 aa, Artificial Sequence
  Description of Artificial Sequence: Synthetic polypeptide
DETEIMTTNPIATECWGATTWANAEDWAEPKGPYI

SEQ ID NO: 206306 - protein, 38 aa, Artificial Sequence
  Description of Artificial Sequence: Synthetic polypeptide
DEQEIATTNPVAYEQWGHCIVAAASGLEDTMNPTNPVH

SEQ ID NO: 206307 - protein, 38 aa, Artificial Sequence
  Description of Artificial Sequence: Synthetic polypeptide
DEQEIATTNPVAYEQWGHCIVAAASGVLEDMNPTNDSH

SEQ ID NO: 206308 - protein, 38 aa, Artificial Sequence
  Description of Artificial Sequence: Synthetic polypeptide
DEECISTTNPVAYEGYGQCVCSNWGEHNAENFNSETQA

SEQ ID NO: 206309 - protein, 38 aa, Artificial Sequence
  Description of Artificial Sequence: Synthetic polypeptide
DEECISTTNPVAYEGYGQCVCSNWGEHNAENFNSENQS

SEQ ID NO: 206310 - protein, 38 aa, Artificial Sequence
  Description of Artificial Sequence: Synthetic polypeptide
DEECISTTNPVAYEGYGQCVCSNWGEHNAENFNSDTQA

SEQ ID NO: 206311 - protein, 35 aa, Artificial Sequence
  Description of Artificial Sequence: Synthetic polypeptide
DETEIKTTNPIATECWGATTWANAEDWAEPKGPYI

SEQ ID NO: 206312 - protein, 38 aa, Artificial Sequence
  Description of Artificial Sequence: Synthetic polypeptide
DEECISTTNPVAYEGYGQCVCSNWGEHNAENFNSDNQA

SEQ ID NO: 206313 - protein, 35 aa, Artificial Sequence
  Description of Artificial Sequence: Synthetic polypeptide
DETEIHTTNPIATECWGATTWANAEDWHEPKGPYI

SEQ ID NO: 206314 - protein, 35 aa, Artificial Sequence
  Description of Artificial Sequence: Synthetic polypeptide
DETEIHTTNPIATECWGATTWANAEDWAEPKGPYI

SEQ ID NO: 206315 - protein, 35 aa, Artificial Sequence
  Description of Artificial Sequence: Synthetic polypeptide
DETEIHTTNPIATECWGATTWANAEDWAELKGPYI

SEQ ID NO: 206316 - protein, 35 aa, Artificial Sequence
  Description of Artificial Sequence: Synthetic polypeptide
DETEIHTTNPIATECWGATTWANAEDWAAPKGPYI

SEQ ID NO: 206317 - protein, 36 aa, Artificial Sequence
  Description of Artificial Sequence: Synthetic polypeptide
DETEIGTTNPIATECWGFATTWANAEDWAEPKGPYI

SEQ ID NO: 206318 - protein, 35 aa, Artificial Sequence
  Description of Artificial Sequence: Synthetic polypeptide
DETEIGTTNPIATECWGATTWANAEDWAEPKGPYI

SEQ ID NO: 206319 - protein, 35 aa, Artificial Sequence
  Description of Artificial Sequence: Synthetic polypeptide
DETEISTTNPIATECWGATTWANAEDWAEPKGPYI

SEQ ID NO: 206320 - protein, 38 aa, Artificial Sequence
  Description of Artificial Sequence: Synthetic polypeptide
DEECISTTNPVAYEGYGQCVCSNWGEHNAENFNSETQG

SEQ ID NO: 206321 - protein, 35 aa, Artificial Sequence
  Description of Artificial Sequence: Synthetic polypeptide
DETEIRTTNPIATECWGATTWAAAEDWAEPEGEYI

SEQ ID NO: 206322 - protein, 35 aa, Artificial Sequence
  Description of Artificial Sequence: Synthetic polypeptide
DETEIRTTNPIATECWGATTWAAAEDWAEPKGPVI

SEQ ID NO: 206323 - protein, 35 aa, Artificial Sequence
  Description of Artificial Sequence: Synthetic polypeptide
DETEIRTTNPIATECWGATTWAAAEDWAEPKGPYI

SEQ ID NO: 206324 - protein, 36 aa, Artificial Sequence
  Description of Artificial Sequence: Synthetic polypeptide
DETEIRTTNPIATECWGATTWANAEDWPAEPKGPYI

SEQ ID NO: 206325 - protein, 36 aa, Artificial Sequence
  Description of Artificial Sequence: Synthetic polypeptide
DETEIRTTNPIATECWGATTWANAEDWPAEIKGPYI

SEQ ID NO: 206326 - protein, 36 aa, Artificial Sequence
  Description of Artificial Sequence: Synthetic polypeptide
DETEIRTTNPIATECWGAYTWANAEDWEEIKGPQIE

SEQ ID NO: 206327 - protein, 36 aa, Artificial Sequence
  Description of Artificial Sequence: Synthetic polypeptide
DETEIRTTNPIATECWGAYTWANAEDWVAEPKGPYI

SEQ ID NO: 206328 - protein, 36 aa, Artificial Sequence
  Description of Artificial Sequence: Synthetic polypeptide
DETEIRTTNPIATECWGAYTWFNAEDWAEIQGPQIQ

SEQ ID NO: 206329 - protein, 36 aa, Artificial Sequence
  Description of Artificial Sequence: Synthetic polypeptide
DETEIRTTNPIATECWGATTWANAEDWNAEPKPPYI

SEQ ID NO: 206330 - protein, 36 aa, Artificial Sequence
  Description of Artificial Sequence: Synthetic polypeptide
DETEIRTTNPIATECWGATTWANAEDWNAEPKGPYI

SEQ ID NO: 206331 - protein, 36 aa, Artificial Sequence
  Description of Artificial Sequence: Synthetic polypeptide
DETEIRTTNPIATECWGATTWANAEDWNAECKGPYI

SEQ ID NO: 206332 - protein, 36 aa, Artificial Sequence
  Description of Artificial Sequence: Synthetic polypeptide
DETEIRTTNPIATECWGATTWANAEDWMAEPKGPYI

SEQ ID NO: 206333 - protein, 38 aa, Artificial Sequence
  Description of Artificial Sequence: Synthetic polypeptide
SSEEIRTTNPVATHGYGQCVCSNWGEHNAEYFNSDTQA

SEQ ID NO: 206334 - protein, 36 aa, Artificial Sequence
  Description of Artificial Sequence: Synthetic polypeptide
DETEIRTTNPIATECWGCQTCGNAEDDAENSGSEFI

SEQ ID NO: 206335 - protein, 36 aa, Artificial Sequence
  Description of Artificial Sequence: Synthetic polypeptide
DETEIRTTNPIATECWGATTWANAEDWKAEPKGPYI

SEQ ID NO: 206336 - protein, 37 aa, Artificial Sequence
  Description of Artificial Sequence: Synthetic polypeptide
DETEIRTTNPIATECWGCQTCQNAEEDAENSGSDNQS

SEQ ID NO: 206337 - protein, 36 aa, Artificial Sequence
  Description of Artificial Sequence: Synthetic polypeptide
DETEIRTTNPIATECWGATTWANAEDWIAEPKGPYI

SEQ ID NO: 206338 - protein, 39 aa, Artificial Sequence
  Description of Artificial Sequence: Synthetic polypeptide
TEECISTTNPVAYEQYGQCVCSNSGEDHNTENFNSDNQA

SEQ ID NO: 206339 - protein, 36 aa, Artificial Sequence
  Description of Artificial Sequence: Synthetic polypeptide
DETEIRTTNPIATECWGATTWANAEDWHEPKGIPYI

SEQ ID NO: 206340 - protein, 36 aa, Artificial Sequence
  Description of Artificial Sequence: Synthetic polypeptide
DETEIRTTNPIATECWGATTWANAEDWHAEPKGPYI

SEQ ID NO: 206341 - protein, 36 aa, Artificial Sequence
  Description of Artificial Sequence: Synthetic polypeptide
DETEIRTTNPIATECWGCTTWANAEDWYEPKGPKIV

SEQ ID NO: 206342 - protein, 36 aa, Artificial Sequence
  Description of Artificial Sequence: Synthetic polypeptide
DETEIRTTNPIATECWGATTWANAEDWGAEPKGPYI

SEQ ID NO: 206343 - protein, 36 aa, Artificial Sequence
  Description of Artificial Sequence: Synthetic polypeptide
DETEIRTTNPIATECWGATTWANAEDWGAEPKGPEI

SEQ ID NO: 206344 - protein, 36 aa, Artificial Sequence
  Description of Artificial Sequence: Synthetic polypeptide
DETEIRTTNPIATECWGATTWANAEDWGAEPHGPYI

SEQ ID NO: 206345 - protein, 36 aa, Artificial Sequence
  Description of Artificial Sequence: Synthetic polypeptide
DETEIRTTNPIATECWGATTWANAEDWFEPKGVPYI

SEQ ID NO: 206346 - protein, 37 aa, Artificial Sequence
  Description of Artificial Sequence: Synthetic polypeptide
QAEEIATTNPVAYEQWGSVCAMNNGGEPDIGVDDEMW

SEQ ID NO: 206347 - protein, 36 aa, Artificial Sequence
  Description of Artificial Sequence: Synthetic polypeptide
DETEIRTTNPIATECWGATTWANAEDWFAEPKGPYI

SEQ ID NO: 206348 - protein, 36 aa, Artificial Sequence
  Description of Artificial Sequence: Synthetic polypeptide
DETEIRTTNPIATECWGATTWANAEDWEEPKGWPYI

SEQ ID NO: 206349 - protein, 38 aa, Artificial Sequence
  Description of Artificial Sequence: Synthetic polypeptide
MEEEIATTNPVATEGYGQCVCSNWGEDNAEGFISDTQA

SEQ ID NO: 206350 - protein, 36 aa, Artificial Sequence
  Description of Artificial Sequence: Synthetic polypeptide
DETEIRTTNPIATECWGATTWANAEDWEEGQGPQIQ

SEQ ID NO: 206351 - protein, 38 aa, Artificial Sequence
  Description of Artificial Sequence: Synthetic polypeptide
DAEEIAATNPVATEQWGGCCAANNGVLDVGMAMDENTP

SEQ ID NO: 206352 - protein, 36 aa, Artificial Sequence
  Description of Artificial Sequence: Synthetic polypeptide
DETEIRTTNPIATECWGATWWANAEDWAEPKGTPYI

SEQ ID NO: 206353 - protein, 36 aa, Artificial Sequence
  Description of Artificial Sequence: Synthetic polypeptide
DETEIRTTNPIATECWGATTWANAEDYWAEPEGPYI

SEQ ID NO: 206354 - protein, 37 aa, Artificial Sequence
  Description of Artificial Sequence: Synthetic polypeptide
SSEEISTTNPVATHGYGCVCSNWGEDNAEYFNSDTQA

SEQ ID NO: 206355 - protein, 39 aa, Artificial Sequence
  Description of Artificial Sequence: Synthetic polypeptide
MEEEIATTNPVAYEGYGQCVCSVWGEDHNAEGFGSDNQA

SEQ ID NO: 206356 - protein, 35 aa, Artificial Sequence
  Description of Artificial Sequence: Synthetic polypeptide
DETEIRTTNPIATECWGATTWANAEDWYEPKQPYI

SEQ ID NO: 206357 - protein, 38 aa, Artificial Sequence
  Description of Artificial Sequence: Synthetic polypeptide
DEECLRTTNPCAYEQYGQCVCSNWGEHNAENFGSDTQA

SEQ ID NO: 206358 - protein, 36 aa, Artificial Sequence
  Description of Artificial Sequence: Synthetic polypeptide
DETEIRTTNPIATECWGATTWANAEDWYAEPKGPYI

SEQ ID NO: 206359 - protein, 38 aa, Artificial Sequence
  Description of Artificial Sequence: Synthetic polypeptide
DEDEIACTNPVATAQWGHSPSATWPAGTNQGNGMEPVN

SEQ ID NO: 206360 - protein, 39 aa, Artificial Sequence
  Description of Artificial Sequence: Synthetic polypeptide
DEDEIACTNPVATEQWGHSCSAMWPANGTNQGNPMEPVM

SEQ ID NO: 206361 - protein, 38 aa, Artificial Sequence
  Description of Artificial Sequence: Synthetic polypeptide
DDSEISTTNPVAYEQYGCVCSNWGEDHNTEHFNSDTQS

SEQ ID NO: 206362 - protein, 36 aa, Artificial Sequence
  Description of Artificial Sequence: Synthetic polypeptide
DETEIRTTNPIATECWGATTWANAEDWWEPKGGPYI

SEQ ID NO: 206363 - protein, 35 aa, Artificial Sequence
  Description of Artificial Sequence: Synthetic polypeptide
DDTEVASTNPIATEGWGNTVWAANEDIQERVGPYI

SEQ ID NO: 206364 - protein, 36 aa, Artificial Sequence
  Description of Artificial Sequence: Synthetic polypeptide
DETEIRTTNPIATECWGATTWANAEDWWAEPKGPYI

SEQ ID NO: 206365 - protein, 36 aa, Artificial Sequence
  Description of Artificial Sequence: Synthetic polypeptide
DETEIRTTNPIATECWGATTWANAEDWVTEPKGPYI

SEQ ID NO: 206366 - protein, 36 aa, Artificial Sequence
  Description of Artificial Sequence: Synthetic polypeptide
DETEIRTTNPIATECWGATTWANAEDWVEEPKGPYI

SEQ ID NO: 206367 - protein, 36 aa, Artificial Sequence
  Description of Artificial Sequence: Synthetic polypeptide
DETEIRTTNPIATECWGATTWANAEDWVAEPKGSYI

SEQ ID NO: 206368 - protein, 36 aa, Artificial Sequence
  Description of Artificial Sequence: Synthetic polypeptide
DETEIRTTNPIATECWGATTWANAEDWVAEPKGPYT

SEQ ID NO: 206369 - protein, 36 aa, Artificial Sequence
  Description of Artificial Sequence: Synthetic polypeptide
DETEIRTTNPIATECWGATTWANAEDWVAEPKGPYI

SEQ ID NO: 206370 - protein, 36 aa, Artificial Sequence
  Description of Artificial Sequence: Synthetic polypeptide
DETEIRTTNPIATECWGATTWANAEDWVAEPKGPYD

SEQ ID NO: 206371 - protein, 36 aa, Artificial Sequence
  Description of Artificial Sequence: Synthetic polypeptide
DETEIRTTNPIATECWGATTWANAEDWTEPKGPYIQ

SEQ ID NO: 206372 - protein, 36 aa, Artificial Sequence
  Description of Artificial Sequence: Synthetic polypeptide
DETEIRTTNPIATECWGATTWANAEDWTAKPKGPYI

SEQ ID NO: 206373 - protein, 36 aa, Artificial Sequence
  Description of Artificial Sequence: Synthetic polypeptide
DETEIRTTNPIATECWGATTWANAEDWTAEPKGPYI

SEQ ID NO: 206374 - protein, 37 aa, Artificial Sequence
  Description of Artificial Sequence: Synthetic polypeptide
QAEEIATTNPVAYEQWGSVCAMNNGGEPDIGPEDEAW

SEQ ID NO: 206375 - protein, 36 aa, Artificial Sequence
  Description of Artificial Sequence: Synthetic polypeptide
DETEIRTTNPIATECWGATTWANAEDWSEPKGLPYI

SEQ ID NO: 206376 - protein, 35 aa, Artificial Sequence
  Description of Artificial Sequence: Synthetic polypeptide
DETEIRTTNPIATECWGATTWANAEDWSEPKCPYI

SEQ ID NO: 206377 - protein, 36 aa, Artificial Sequence
  Description of Artificial Sequence: Synthetic polypeptide
DETEIRTTNPIATECWGATTWANAEDWSAEPKGPYI

SEQ ID NO: 206378 - protein, 36 aa, Artificial Sequence
  Description of Artificial Sequence: Synthetic polypeptide
DETEIRTTNPIATECWGATTWANAEDWPHEPKGPYI

SEQ ID NO: 206379 - protein, 36 aa, Artificial Sequence
  Description of Artificial Sequence: Synthetic polypeptide
DETEIRTTNPIATECWGATTWANAEDWEAEPKGPYI

SEQ ID NO: 206380 - protein, 37 aa, Artificial Sequence
  Description of Artificial Sequence: Synthetic polypeptide
QAEEIATTNPVATESYGCVAAGEGGHGNESGEEEGVT

SEQ ID NO: 206381 - protein, 36 aa, Artificial Sequence
  Description of Artificial Sequence: Synthetic polypeptide
DETEIRTTNPIATECWGATTWANAEDWDAEPKGPYI

SEQ ID NO: 206382 - protein, 36 aa, Artificial Sequence
  Description of Artificial Sequence: Synthetic polypeptide
DETEIRTTNPIATECWGNATCWANAEDWEEPQEPQI

SEQ ID NO: 206383 - protein, 36 aa, Artificial Sequence
  Description of Artificial Sequence: Synthetic polypeptide
DETEIRTTNPIATECWGNTTWANAEDWAEPKGPYIY

SEQ ID NO: 206384 - protein, 36 aa, Artificial Sequence
  Description of Artificial Sequence: Synthetic polypeptide
DETEIRTTNPIATECWGQTTWANAEDTWAEPKGPYI

SEQ ID NO: 206385 - protein, 36 aa, Artificial Sequence
  Description of Artificial Sequence: Synthetic polypeptide
DETEIRTTNPIATECWGATTWANAEDWAEPLGPYIQ

SEQ ID NO: 206386 - protein, 35 aa, Artificial Sequence
  Description of Artificial Sequence: Synthetic polypeptide
DETEIRTTNPIATECWGATTWANAEDWAEPKYPYI

SEQ ID NO: 206387 - protein, 35 aa, Artificial Sequence
  Description of Artificial Sequence: Synthetic polypeptide
DETEIRTTNPIATECWGATTWANAEDWAEPKYAYI

SEQ ID NO: 206388 - protein, 35 aa, Artificial Sequence
  Description of Artificial Sequence: Synthetic polypeptide
DETEIRTTNPIATECWGATTWANAEDWAEPKWPYI

SEQ ID NO: 206389 - protein, 35 aa, Artificial Sequence
  Description of Artificial Sequence: Synthetic polypeptide
DETEIRTTNPIATECWGATTWANAEDWAEPKVPYI

SEQ ID NO: 206390 - protein, 35 aa, Artificial Sequence
  Description of Artificial Sequence: Synthetic polypeptide
DETEIRTTNPIATECWGATTWANAEDWAEPKVDYI

SEQ ID NO: 206391 - protein, 35 aa, Artificial Sequence
  Description of Artificial Sequence: Synthetic polypeptide
DETEIRTTNPIATECWGATTWANAEDWAEPKTPYI

SEQ ID NO: 206392 - protein, 35 aa, Artificial Sequence
  Description of Artificial Sequence: Synthetic polypeptide
DETEIRTTNPIATECWGATTWANAEDWAEPKTPPI

SEQ ID NO: 206393 - protein, 39 aa, Artificial Sequence
  Description of Artificial Sequence: Synthetic polypeptide
DEDEIACTNPVATEQWGHSWCSAMWPAGTNQGNPMEPVI

SEQ ID NO: 206394 - protein, 37 aa, Artificial Sequence
  Description of Artificial Sequence: Synthetic polypeptide
MEDEIRGTNCVATEAWGCVSVAINGEGGDGEGEENQS

SEQ ID NO: 206395 - protein, 35 aa, Artificial Sequence
  Description of Artificial Sequence: Synthetic polypeptide
DETEIRTTNPIATECWGATTWANAEDWAEPKSPYI

SEQ ID NO: 206396 - protein, 38 aa, Artificial Sequence
  Description of Artificial Sequence: Synthetic polypeptide
SQEEIRTTNPVAYEGWGCVCSNWGEDHNAENFGSDNQA

SEQ ID NO: 206397 - protein, 35 aa, Artificial Sequence
  Description of Artificial Sequence: Synthetic polypeptide
DETEIRTTNPIATECWGATTWANAEDWAEPKQPYM

SEQ ID NO: 206398 - protein, 35 aa, Artificial Sequence
  Description of Artificial Sequence: Synthetic polypeptide
DETEIRTTNPIATECWGATTWANAEDWAEPKQPYI

SEQ ID NO: 206399 - protein, 35 aa, Artificial Sequence
  Description of Artificial Sequence: Synthetic polypeptide
DETEIRTTNPIATECWGATTWANAEDWAEPKQPYG

SEQ ID NO: 206400 - protein, 35 aa, Artificial Sequence
  Description of Artificial Sequence: Synthetic polypeptide
DETEIRTTNPIATECWGATTWANAEDWAEPKQPYC

SEQ ID NO: 206401 - protein, 36 aa, Artificial Sequence
  Description of Artificial Sequence: Synthetic polypeptide
DETEIRTTNPIATECWGATTWANAEDWAEPKQIPYI

SEQ ID NO: 206402 - protein, 35 aa, Artificial Sequence
  Description of Artificial Sequence: Synthetic polypeptide
DETEIRTTNPIATECWGATTWANAEDWAEPKPPYI

SEQ ID NO: 206403 - protein, 35 aa, Artificial Sequence
  Description of Artificial Sequence: Synthetic polypeptide
DETEIRTTNPIATECWGATTWANAEDWAEPKMPYI

SEQ ID NO: 206404 - protein, 35 aa, Artificial Sequence
  Description of Artificial Sequence: Synthetic polypeptide
DETEIRTTNPIATECWGATTWANAEDWAEPKMHYI

SEQ ID NO: 206405 - protein, 35 aa, Artificial Sequence
  Description of Artificial Sequence: Synthetic polypeptide
DETEIRTTNPIATECWGATTWANAEDWAEPKLSYI

SEQ ID NO: 206406 - protein, 36 aa, Artificial Sequence
  Description of Artificial Sequence: Synthetic polypeptide
DETEIRTTNPIATECWGRTTWANAEDPWAEPKGPYI

SEQ ID NO: 206407 - protein, 37 aa, Artificial Sequence
  Description of Artificial Sequence: Synthetic polypeptide
DETEIRTTNPIATECWGMATTWANAEDWSAEPKGPYI

SEQ ID NO: 206408 - protein, 37 aa, Artificial Sequence
  Description of Artificial Sequence: Synthetic polypeptide
DETEIRTTNPIATECWGMATTWANAEDWAEPKGWPYI

SEQ ID NO: 206409 - protein, 37 aa, Artificial Sequence
  Description of Artificial Sequence: Synthetic polypeptide
DETEIRTTNPIATECWGMATTWANAEDWAEPKGPYIA

SEQ ID NO: 206410 - protein, 36 aa, Artificial Sequence
  Description of Artificial Sequence: Synthetic polypeptide
DETEIRTTNPIATECWGKTTVACAEDEAEPTGTPYI

SEQ ID NO: 206411 - protein, 37 aa, Artificial Sequence
  Description of Artificial Sequence: Synthetic polypeptide
QAEEIATTNPVAYEQWGSVCAMNNGIGEPDIGGGDMW

SEQ ID NO: 206412 - protein, 36 aa, Artificial Sequence
  Description of Artificial Sequence: Synthetic polypeptide
DETEIRTTNPIATECWGATTWANAEDWDAEPKGPYD

SEQ ID NO: 206413 - protein, 36 aa, Artificial Sequence
  Description of Artificial Sequence: Synthetic polypeptide
DETEIRTTNPIATECWGATTWANAEDWDAEMKGPYI

SEQ ID NO: 206414 - protein, 35 aa, Artificial Sequence
  Description of Artificial Sequence: Synthetic polypeptide
DETEIRTTNPIATECWGETTWANDEDWAEPKKPYI

SEQ ID NO: 206415 - protein, 36 aa, Artificial Sequence
  Description of Artificial Sequence: Synthetic polypeptide
DETEIRTTNPIATECWGATTWANAEDWCAEPTGPYI

SEQ ID NO: 206416 - protein, 36 aa, Artificial Sequence
  Description of Artificial Sequence: Synthetic polypeptide
DETEIRTTNPIATECWGATTWANAEDWCAEPKGPYI

SEQ ID NO: 206417 - protein, 36 aa, Artificial Sequence
  Description of Artificial Sequence: Synthetic polypeptide
DETEIRTTNPIATECWGATTWANAEDWCAEPKGPDI

SEQ ID NO: 206418 - protein, 36 aa, Artificial Sequence
  Description of Artificial Sequence: Synthetic polypeptide
DETEIRTTNPIATECWGFTTWANAEDWPAEPKGPYI

SEQ ID NO: 206419 - protein, 36 aa, Artificial Sequence
  Description of Artificial Sequence: Synthetic polypeptide
DETEIRTTNPIATECWGGTTWANAEDWAAEPKGPYI

SEQ ID NO: 206420 - protein, 35 aa, Artificial Sequence
  Description of Artificial Sequence: Synthetic polypeptide
DETEIRTTNPIATECWGATTWANAEDWAVPKDPYI

SEQ ID NO: 206421 - protein, 37 aa, Artificial Sequence
  Description of Artificial Sequence: Synthetic polypeptide
QAEEIATTNPVATESWGCVAAGEGGHGNESGEEEGMR

SEQ ID NO: 206422 - protein, 36 aa, Artificial Sequence
  Description of Artificial Sequence: Synthetic polypeptide
DETEIRTTNPIATECWGHATCWANAEDWEEGQGPQI

SEQ ID NO: 206423 - protein, 37 aa, Artificial Sequence
  Description of Artificial Sequence: Synthetic polypeptide
SSEEISTTNPVATHGYGCVCSNWGEHNAENFGSDTQA

SEQ ID NO: 206424 - protein, 36 aa, Artificial Sequence
  Description of Artificial Sequence: Synthetic polypeptide
DETEIRTTNPIATECWGATTWANAEDWASPKGPYIQ

SEQ ID NO: 206425 - protein, 35 aa, Artificial Sequence
  Description of Artificial Sequence: Synthetic polypeptide
DETEIRTTNPIATECWGATTWANAEDWASPKAPYI

SEQ ID NO: 206426 - protein, 37 aa, Artificial Sequence
  Description of Artificial Sequence: Synthetic polypeptide
DETEIRTTNPIATECWGIATTWANAEDWAEPKGEPYI

SEQ ID NO: 206427 - protein, 34 aa, Artificial Sequence
  Description of Artificial Sequence: Synthetic polypeptide
QEGEIACTNPCSYEQWGITCYCNDQHDHGDTKRE

SEQ ID NO: 206428 - protein, 37 aa, Artificial Sequence
  Description of Artificial Sequence: Synthetic polypeptide
DETEIRTTNPIATECWGIATTWANAEDWAEPKGYPYI

SEQ ID NO: 206429 - protein, 36 aa, Artificial Sequence
  Description of Artificial Sequence: Synthetic polypeptide
DETEIRTTNPIATECWGITTWANAEDWAEPKGPYIC

SEQ ID NO: 206430 - protein, 36 aa, Artificial Sequence
  Description of Artificial Sequence: Synthetic polypeptide
DETEIRTTNPIATECWGATTWANAEDWAKPKGPYIY

SEQ ID NO: 206431 - protein, 37 aa, Artificial Sequence
  Description of Artificial Sequence: Synthetic polypeptide
SSEEIRTTNPVATCGYGCVCSWGEDHNAENFISDTQA

SEQ ID NO: 206432 - protein, 37 aa, Artificial Sequence
  Description of Artificial Sequence: Synthetic polypeptide
DETEIRTTNPIATECWGKATTWANAEDIWAEPKGPYI

SEQ ID NO: 206433 - protein, 38 aa, Artificial Sequence
  Description of Artificial Sequence: Synthetic polypeptide
MEDEIRGTNPVATDQYGSVVGMGVPGQGLDQGMDTEGG

SEQ ID NO: 206434 - protein, 35 aa, Artificial Sequence
  Description of Artificial Sequence: Synthetic polypeptide
DETEIRTTNPIATECWGATTWANAEDWAFPKDPYI

SEQ ID NO: 206435 - protein, 36 aa, Artificial Sequence
  Description of Artificial Sequence: Synthetic polypeptide
DETEIRTTNPIATECWGATTWANAEDWAEYKGPYIM

SEQ ID NO: 206436 - protein, 37 aa, Artificial Sequence
  Description of Artificial Sequence: Synthetic polypeptide
DETEIRTTNPIATECWGKATTWANAEDWLEEPKTPYI

SEQ ID NO: 206437 - protein, 37 aa, Artificial Sequence
  Description of Artificial Sequence: Synthetic polypeptide
DETEIRTTNPIATECWGHATTWANAEDWAEPKGIPYI

SEQ ID NO: 206438 - protein, 38 aa, Artificial Sequence
  Description of Artificial Sequence: Synthetic polypeptide
MEEEIATTNPVAYEGYGQCVCSVWGEDNAEGFNSDTQS

SEQ ID NO: 206439 - protein, 38 aa, Artificial Sequence
  Description of Artificial Sequence: Synthetic polypeptide
SSEEISTTNPVATHQYGQCVCSNWGEDNAENFGSDTQS

SEQ ID NO: 206440 - protein, 36 aa, Artificial Sequence
  Description of Artificial Sequence: Synthetic polypeptide
DETEIRTTNPIATECWGATTWANAEDYWAEPKGPYI

SEQ ID NO: 206441 - protein, 36 aa, Artificial Sequence
  Description of Artificial Sequence: Synthetic polypeptide
DETEIRTTNPIATECWGATTWCNAEDMWAEPKGPYI

SEQ ID NO: 206442 - protein, 35 aa, Artificial Sequence
  Description of Artificial Sequence: Synthetic polypeptide
DETEIRTTNPIATECWGATTWCNAEDWAEPKFPYI

SEQ ID NO: 206443 - protein, 39 aa, Artificial Sequence
  Description of Artificial Sequence: Synthetic polypeptide
MEEEIRTTNPVATEFYGCVVNMQGINNMDNMTGEFTEEG

SEQ ID NO: 206444 - protein, 36 aa, Artificial Sequence
  Description of Artificial Sequence: Synthetic polypeptide
DETEIRTTNPIATECWGATTWANGEDWAEPKGFPYI

SEQ ID NO: 206445 - protein, 35 aa, Artificial Sequence
  Description of Artificial Sequence: Synthetic polypeptide
DETEIRTTNPIATECWGATTWEHAEDWAEPKGPYI

SEQ ID NO: 206446 - protein, 34 aa, Artificial Sequence
  Description of Artificial Sequence: Synthetic polypeptide
TEDMIASVNPVCYEPYGVTVNTIALSTAAGGNNV

SEQ ID NO: 206447 - protein, 35 aa, Artificial Sequence
  Description of Artificial Sequence: Synthetic polypeptide
QAEEIATTNPVAYEQWGHCNNFAGNGGDATANAEN

SEQ ID NO: 206448 - protein, 36 aa, Artificial Sequence
  Description of Artificial Sequence: Synthetic polypeptide
DETEIRTTNPIATECWGATTWENAEDGWAEPKGPYI

SEQ ID NO: 206449 - protein, 36 aa, Artificial Sequence
  Description of Artificial Sequence: Synthetic polypeptide
DETEIRTTNPIATECWGATTWENAEDPWAEPKGPYI

SEQ ID NO: 206450 - protein, 36 aa, Artificial Sequence
  Description of Artificial Sequence: Synthetic polypeptide
DETEIRTTNPIATECWGATTWANEEDWFAEPKGPYI

SEQ ID NO: 206451 - protein, 38 aa, Artificial Sequence
  Description of Artificial Sequence: Synthetic polypeptide
DEAAISTTNPVATEQYGCFCSNWGEDHNIENFNSDTQS

SEQ ID NO: 206452 - protein, 34 aa, Artificial Sequence
  Description of Artificial Sequence: Synthetic polypeptide
QEGEIACTNPCSYEQWGITCYCNDQQDEGDMVRD

SEQ ID NO: 206453 - protein, 36 aa, Artificial Sequence
  Description of Artificial Sequence: Synthetic polypeptide
DETEIRTTNPIATECWGATTWFNAEDWNEPLEPYIE

SEQ ID NO: 206454 - protein, 36 aa, Artificial Sequence
  Description of Artificial Sequence: Synthetic polypeptide
DETEIRTTNPIATECWGATTWHNAEDWAEPKGPYIP

SEQ ID NO: 206455 - protein, 36 aa, Artificial Sequence
  Description of Artificial Sequence: Synthetic polypeptide
DETEIRTTNPIATECWGATTWINAEDDWAEPKGPYI

SEQ ID NO: 206456 - protein, 36 aa, Artificial Sequence
  Description of Artificial Sequence: Synthetic polypeptide
DETEIRTTNPIATECWGATTWINAEDWAEPKGPYIG

SEQ ID NO: 206457 - protein, 40 aa, Artificial Sequence
  Description of Artificial Sequence: Synthetic polypeptide
DEEEIGTTNPVATEGYGQCQVCSNWGEDHNAENFNSENQS

SEQ ID NO: 206458 - protein, 38 aa, Artificial Sequence
  Description of Artificial Sequence: Synthetic polypeptide
DEMEIATTNPVAYEGYGCVCSNWMEDHNEEHFGSETQA

SEQ ID NO: 206459 - protein, 36 aa, Artificial Sequence
  Description of Artificial Sequence: Synthetic polypeptide
TEAEIRCTNPVSYEPWGKISCMEDSISDQMNGGNTS

SEQ ID NO: 206460 - protein, 40 aa, Artificial Sequence
  Description of Artificial Sequence: Synthetic polypeptide
TEAEIKTTNPVATEGYGVVDVGVGTGNVGQQEGNEGNDDQ

SEQ ID NO: 206461 - protein, 36 aa, Artificial Sequence
  Description of Artificial Sequence: Synthetic polypeptide
DETEIRTTNPIATECWGATTWANATDWAEPKGHPYI

SEQ ID NO: 206462 - protein, 36 aa, Artificial Sequence
  Description of Artificial Sequence: Synthetic polypeptide
DETEIRTTNPIATECWGATTWANATDGGAEPKGPYI

SEQ ID NO: 206463 - protein, 36 aa, Artificial Sequence
  Description of Artificial Sequence: Synthetic polypeptide
DETEIRTTNPIATECWGATTWLNAEDEWAEPKGPYI

SEQ ID NO: 206464 - protein, 37 aa, Artificial Sequence
  Description of Artificial Sequence: Synthetic polypeptide
TEAEIATTNPVAYERWGSVACAQPNEEQGEQMGMDKS

SEQ ID NO: 206465 - protein, 36 aa, Artificial Sequence
  Description of Artificial Sequence: Synthetic polypeptide
DETEIRTTNPIATECWGATTWLNAEDWAEPKGVPYI

SEQ ID NO: 206466 - protein, 35 aa, Artificial Sequence
  Description of Artificial Sequence: Synthetic polypeptide
DETEIRTTNPIATECWGATTWAYAEDWEEPKGPYI

SEQ ID NO: 206467 - protein, 35 aa, Artificial Sequence
  Description of Artificial Sequence: Synthetic polypeptide
DETEIRTTNPIATECWGATTWAYAEDWAEPKGPYI

SEQ ID NO: 206468 - protein, 35 aa, Artificial Sequence
  Description of Artificial Sequence: Synthetic polypeptide
DETEIRTTNPIATECWGATTWAWAEDWCEPKGPYI

SEQ ID NO: 206469 - protein, 36 aa, Artificial Sequence
  Description of Artificial Sequence: Synthetic polypeptide
DETEIRTTNPIATECWGATTWANIEDWAEPKGPPYI

SEQ ID NO: 206470 - protein, 36 aa, Artificial Sequence
  Description of Artificial Sequence: Synthetic polypeptide
DETEIRTTNPIATECWGATTWANTEDWVEEPKGPYI

SEQ ID NO: 206471 - protein, 36 aa, Artificial Sequence
  Description of Artificial Sequence: Synthetic polypeptide
DETEIRTTNPIATECWGATTWANSEDWAEPKGPPYI

SEQ ID NO: 206472 - protein, 37 aa, Artificial Sequence
  Description of Artificial Sequence: Synthetic polypeptide
TEDEIATTNPVAYEQWGVYFTTVTIDHQQKDSKGNSP

SEQ ID NO: 206473 - protein, 36 aa, Artificial Sequence
  Description of Artificial Sequence: Synthetic polypeptide
DETEIRTTNPIATECWGATTWANSEDVWAEPKGPYI

SEQ ID NO: 206474 - protein, 35 aa, Artificial Sequence
  Description of Artificial Sequence: Synthetic polypeptide
DETEIRTTNPIATECWGATTWAPAEDWAEPKGPYI

SEQ ID NO: 206475 - protein, 38 aa, Artificial Sequence
  Description of Artificial Sequence: Synthetic polypeptide
DEMEIATTNPVAYEGYGQCVCSNWGEHNAEHFISENQS

SEQ ID NO: 206476 - protein, 35 aa, Artificial Sequence
  Description of Artificial Sequence: Synthetic polypeptide
TEASIAATNPVAYDPWGIVPPCTAEHSQRSGENQD

SEQ ID NO: 206477 - protein, 36 aa, Artificial Sequence
  Description of Artificial Sequence: Synthetic polypeptide
DETEIRTTNPIATECWGATTWANPEDWAEPKGPYIW

SEQ ID NO: 206478 - protein, 36 aa, Artificial Sequence
  Description of Artificial Sequence: Synthetic polypeptide
QAEEIATTNPVAYEQWGHCNVFAGNGGDATANPEHF

SEQ ID NO: 206479 - protein, 35 aa, Artificial Sequence
  Description of Artificial Sequence: Synthetic polypeptide
DETEIRTTNPIATECWGATTWARAEDWAEPKGPYI

SEQ ID NO: 206480 - protein, 35 aa, Artificial Sequence
  Description of Artificial Sequence: Synthetic polypeptide
DETEIRTTNPIATECWGATTWANNEDWAEPKSPYI

SEQ ID NO: 206481 - protein, 36 aa, Artificial Sequence
  Description of Artificial Sequence: Synthetic polypeptide
DETEIRTTNPIATECWGATTWANNEDWAEPKGQPYI

SEQ ID NO: 206482 - protein, 36 aa, Artificial Sequence
  Description of Artificial Sequence: Synthetic polypeptide
DETEIRTTNPIATECWGATTWMNAEDWAEPKGPYID

SEQ ID NO: 206483 - protein, 36 aa, Artificial Sequence
  Description of Artificial Sequence: Synthetic polypeptide
DETEIRTTNPIATECWGATTWATAEDWAEPKGAPYI

SEQ ID NO: 206484 - protein, 35 aa, Artificial Sequence
  Description of Artificial Sequence: Synthetic polypeptide
DETEIRTTNPIATECWGATTWATAEDWAEPKIPYI

SEQ ID NO: 206485 - protein, 39 aa, Artificial Sequence
  Description of Artificial Sequence: Synthetic polypeptide
ADEEIATTNPVATEQYGQCVCSNWGEDHNAENFNSDNQS

SEQ ID NO: 206486 - protein, 36 aa, Artificial Sequence
  Description of Artificial Sequence: Synthetic polypeptide
DETEIRTTNPIATECWGATTWANMEDEWAEPKGPYI

SEQ ID NO: 206487 - protein, 39 aa, Artificial Sequence
  Description of Artificial Sequence: Synthetic polypeptide
DEMEIATTNPVAYEGYGQCVCSNWGEDDNEEHFGSENQA

SEQ ID NO: 206488 - protein, 35 aa, Artificial Sequence
  Description of Artificial Sequence: Synthetic polypeptide
DETEIRTTNPIATECWGATTWAWAEDWADPKGPYI

SEQ ID NO: 206489 - protein, 35 aa, Artificial Sequence
  Description of Artificial Sequence: Synthetic polypeptide
DETEIRTTNPIATECWGATTWAWAEDWAEPKGPWI

SEQ ID NO: 206490 - protein, 35 aa, Artificial Sequence
  Description of Artificial Sequence: Synthetic polypeptide
DDSEVACTNPVSTEGYGCVCFNSEINAEYFGSQQS

SEQ ID NO: 206491 - protein, 35 aa, Artificial Sequence
  Description of Artificial Sequence: Synthetic polypeptide
DETEIRTTNPIATECWGATTWAWAEDWAEPKGPYI

SEQ ID NO: 206492 - protein, 36 aa, Artificial Sequence
  Description of Artificial Sequence: Synthetic polypeptide
DETEIRTTNPIATECWGATTWANKEDWAEPKGWPYI

SEQ ID NO: 206493 - protein, 35 aa, Artificial Sequence
  Description of Artificial Sequence: Synthetic polypeptide
DETEIRTTNPIATECWGATTWAWAEDWAEPKGPYK

SEQ ID NO: 206494 - protein, 36 aa, Artificial Sequence
  Description of Artificial Sequence: Synthetic polypeptide
DETEIRTTNPIATECWGATTWANKEDGWAEPKGPYI

SEQ ID NO: 206495 - protein, 36 aa, Artificial Sequence
  Description of Artificial Sequence: Synthetic polypeptide
DETEIRTTNPIATECWGATTWANIEDWWAEPKGPYI

SEQ ID NO: 206496 - protein, 35 aa, Artificial Sequence
  Description of Artificial Sequence: Synthetic polypeptide
DDSEVACTNPVSTEGYGCVCGNWEHQEYFGSQTQA

SEQ ID NO: 206497 - protein, 35 aa, Artificial Sequence
  Description of Artificial Sequence: Synthetic polypeptide
DETEIRTTNPIATECWGATTWANAEDWAEPKLPYI

SEQ ID NO: 206498 - protein, 36 aa, Artificial Sequence
  Description of Artificial Sequence: Synthetic polypeptide
DETEIRTTNPIATECWGATTWANAPDWAEPKGPYIW

SEQ ID NO: 206499 - protein, 36 aa, Artificial Sequence
  Description of Artificial Sequence: Synthetic polypeptide
DETEIRTTNPIATECWGATTWNNAEDYWAEPKGPYI

SEQ ID NO: 206500 - protein, 39 aa, Artificial Sequence
  Description of Artificial Sequence: Synthetic polypeptide
AEEEIRTTNPVATEGYGQCVCGNWGEDHNAENFNSETQA

SEQ ID NO: 206501 - protein, 33 aa, Artificial Sequence
  Description of Artificial Sequence: Synthetic polypeptide
QEGEIACTNPCSYEQWGITCYCNDQQDHGDSVP

SEQ ID NO: 206502 - protein, 39 aa, Artificial Sequence
  Description of Artificial Sequence: Synthetic polypeptide
DEAAPEIAAACTNPVAYEQWGCNVTASANLSENSGHPNN

SEQ ID NO: 206503 - protein, 39 aa, Artificial Sequence
  Description of Artificial Sequence: Synthetic polypeptide
AEEEIRTTNPVATEGYGQCVCGNWGEDHNAENFNSENQA

SEQ ID NO: 206504 - protein, 36 aa, Artificial Sequence
  Description of Artificial Sequence: Synthetic polypeptide
DETEIRTTNPIATECWGATTWWNAEDWAEPKGAPYI

SEQ ID NO: 206505 - protein, 36 aa, Artificial Sequence
  Description of Artificial Sequence: Synthetic polypeptide
DETEIRTTNPIATECWGATTWWNAEDWAEPKGPYIA

SEQ ID NO: 206506 - protein, 36 aa, Artificial Sequence
  Description of Artificial Sequence: Synthetic polypeptide
DETEIRTTNPIATECWGATTWYNAEDWWAEPKGPYI

SEQ ID NO: 206507 - protein, 35 aa, Artificial Sequence
  Description of Artificial Sequence: Synthetic polypeptide
DETEIRTTNPIATECWGATTYACAEDWAEPAGPYI

SEQ ID NO: 206508 - protein, 36 aa, Artificial Sequence
  Description of Artificial Sequence: Synthetic polypeptide
DETEIRTTNPIATECWGATTYANAEDIWAEPKGPYI

SEQ ID NO: 206509 - protein, 36 aa, Artificial Sequence
  Description of Artificial Sequence: Synthetic polypeptide
DETEIRTTNPIATECWGATTWANAEMWAAEPKGPYI

SEQ ID NO: 206510 - protein, 36 aa, Artificial Sequence
  Description of Artificial Sequence: Synthetic polypeptide
DETEIRTTNPIATECWGATTYANAEDWDSEPKGPYI

SEQ ID NO: 206511 - protein, 35 aa, Artificial Sequence
  Description of Artificial Sequence: Synthetic polypeptide
TADEIASVNPVCYEPYGVTVNTINLSTAAAGGNNV

SEQ ID NO: 206512 - protein, 35 aa, Artificial Sequence
  Description of Artificial Sequence: Synthetic polypeptide
DETEIRTTNPIATECWGATTYAPAEDWAEPKGPYI

SEQ ID NO: 206513 - protein, 35 aa, Artificial Sequence
  Description of Artificial Sequence: Synthetic polypeptide
DEDEIACTNPVATASWGCVAATGQEADTPGGDTLW

SEQ ID NO: 206514 - protein, 36 aa, Artificial Sequence
  Description of Artificial Sequence: Synthetic polypeptide
DETEIRTTNPIATECWGATTWANAEKWAEPKGPYIT

SEQ ID NO: 206515 - protein, 38 aa, Artificial Sequence
  Description of Artificial Sequence: Synthetic polypeptide
STNEIRTTNPVATEQYGTLVTCDYSEPVTTEVHEDHED

SEQ ID NO: 206516 - protein, 35 aa, Artificial Sequence
  Description of Artificial Sequence: Synthetic polypeptide
DETEIRTTNPIATECWGATTWANAEKWAEPKAPYI

SEQ ID NO: 206517 - protein, 35 aa, Artificial Sequence
  Description of Artificial Sequence: Synthetic polypeptide
DDSELASTNPVSTEGYGCVCFTWEINQENFGSQQA

SEQ ID NO: 206518 - protein, 36 aa, Artificial Sequence
  Description of Artificial Sequence: Synthetic polypeptide
DETEIRTTNPIATECWGATTWANAEIWAEPKGAPYI

SEQ ID NO: 206519 - protein, 35 aa, Artificial Sequence
  Description of Artificial Sequence: Synthetic polypeptide
DETEIRTTNPIATECWGATTWANAEIWAEPKEPYI

SEQ ID NO: 206520 - protein, 38 aa, Artificial Sequence
  Description of Artificial Sequence: Synthetic polypeptide
DEACIGTTNPVATEQWGCVCSNWGDDHNAEYFGSDTQA

SEQ ID NO: 206521 - protein, 39 aa, Artificial Sequence
  Description of Artificial Sequence: Synthetic polypeptide
MEEEIRATNPVATEFYGVTVNMQGINNMDNQTGEFTEEG

SEQ ID NO: 206522 - protein, 37 aa, Artificial Sequence
  Description of Artificial Sequence: Synthetic polypeptide
DEECLSTTNPCAYEQYGCVCSWGEDHNQENFGSDTQA

SEQ ID NO: 206523 - protein, 38 aa, Artificial Sequence
  Description of Artificial Sequence: Synthetic polypeptide
DEACIGTTNPVATEQYGQCVCENWGEPNAEYFGSDTQS

SEQ ID NO: 206524 - protein, 37 aa, Artificial Sequence
  Description of Artificial Sequence: Synthetic polypeptide
QAEEIATTNPVAYEQWGSVCAMNNGGEADIGGEDEMW

SEQ ID NO: 206525 - protein, 35 aa, Artificial Sequence
  Description of Artificial Sequence: Synthetic polypeptide
DDSEVACTNPVSTEGYGCVCQTWETNQEYFGSQQS

SEQ ID NO: 206526 - protein, 36 aa, Artificial Sequence
  Description of Artificial Sequence: Synthetic polypeptide
DETEIRTTNPIATECWGATTWANAESWAEPKGFSIN

SEQ ID NO: 206527 - protein, 39 aa, Artificial Sequence
  Description of Artificial Sequence: Synthetic polypeptide
DEAAISTTNPVAYEQYGQCVCSNWEEDTNAENFNSDTQQ

SEQ ID NO: 206528 - protein, 36 aa, Artificial Sequence
  Description of Artificial Sequence: Synthetic polypeptide
DETEIRTTNPIATECWGATTWANAESWGAEPKGPYI

SEQ ID NO: 206529 - protein, 36 aa, Artificial Sequence
  Description of Artificial Sequence: Synthetic polypeptide
DETEIRTTNPIATECWGATTWANAMDMWAEPKGPYI

SEQ ID NO: 206530 - protein, 36 aa, Artificial Sequence
  Description of Artificial Sequence: Synthetic polypeptide
DETEIRTTNPIATECWGATTWRNAEDWAEPKGPYIQ

SEQ ID NO: 206531 - protein, 35 aa, Artificial Sequence
  Description of Artificial Sequence: Synthetic polypeptide
DETEIRTTNPIATECWGATTWRNAEDWAEPKPPYI

SEQ ID NO: 206532 - protein, 36 aa, Artificial Sequence
  Description of Artificial Sequence: Synthetic polypeptide
QAEEIATTNPVAYEQWGSICAMNNGGEADIGGTEMW

SEQ ID NO: 206533 - protein, 36 aa, Artificial Sequence
  Description of Artificial Sequence: Synthetic polypeptide
QAEEIATTNPVAYEQWGSICAMNNGGEPDIGLDDMW

SEQ ID NO: 206534 - protein, 34 aa, Artificial Sequence
  Description of Artificial Sequence: Synthetic polypeptide
TEAEIASTNPVGTEPWGVCAPTDRDQHQGQHQDD

SEQ ID NO: 206535 - protein, 35 aa, Artificial Sequence
  Description of Artificial Sequence: Synthetic polypeptide
DETEIRTTNPIATECWGATTWANAIDWAEPKDPYI

SEQ ID NO: 206536 - protein, 38 aa, Artificial Sequence
  Description of Artificial Sequence: Synthetic polypeptide
DEAEIRTTNPVAYEQYGQCICSNWGEDHNEENFPSDQA

SEQ ID NO: 206537 - protein, 35 aa, Artificial Sequence
  Description of Artificial Sequence: Synthetic polypeptide
DETEIRTTNPIATECWGATTWANAHDWAEPKYPYI

SEQ ID NO: 206538 - protein, 36 aa, Artificial Sequence
  Description of Artificial Sequence: Synthetic polypeptide
DETEIRTTNPIATECWGATTWANAHDWAEPKGPYIS

SEQ ID NO: 206539 - protein, 39 aa, Artificial Sequence
  Description of Artificial Sequence: Synthetic polypeptide
DEAAISTTNPVATEQYGQCVCSNWGEAHNAENFNSETQS

SEQ ID NO: 206540 - protein, 39 aa, Artificial Sequence
  Description of Artificial Sequence: Synthetic polypeptide
DEAAISTTNPVATEQYGQCVCSNWGEDHNAEYFNSDTQS

SEQ ID NO: 206541 - protein, 35 aa, Artificial Sequence
  Description of Artificial Sequence: Synthetic polypeptide
DETEIRTTNPIATECWGATTWANANDWAEPKHPYI

SEQ ID NO: 206542 - protein, 36 aa, Artificial Sequence
  Description of Artificial Sequence: Synthetic polypeptide
DDSEVACTNPVSTEGYGCVCGTWEINQESFGSQNQA

SEQ ID NO: 206543 - protein, 38 aa, Artificial Sequence
  Description of Artificial Sequence: Synthetic polypeptide
DEAEIRTTNPVAYEQYGQCICSNWGEHNEENFMSDTQA

SEQ ID NO: 206544 - protein, 39 aa, Artificial Sequence
  Description of Artificial Sequence: Synthetic polypeptide
DEAAISTTNPVATEQYGQCVCSNWGEDHNQENFNSDNQS

SEQ ID NO: 206545 - protein, 37 aa, Artificial Sequence
  Description of Artificial Sequence: Synthetic polypeptide
QAEEIATTNPVAYEQWGSICAMNNGKGEPDIQGGDMW

SEQ ID NO: 206546 - protein, 36 aa, Artificial Sequence
  Description of Artificial Sequence: Synthetic polypeptide
DETEIRTTNPIATECWGATTWSNAEDWPAEPKGPYI

SEQ ID NO: 206547 - protein, 35 aa, Artificial Sequence
  Description of Artificial Sequence: Synthetic polypeptide
DDTEIATTNPVSTEGWGATVWAAAEDIAEPKGPYR

SEQ ID NO: 206548 - protein, 38 aa, Artificial Sequence
  Description of Artificial Sequence: Synthetic polypeptide
TDEVEEEICSTNPVAYEQWGCTYMNDNHNDKNGENGVR

SEQ ID NO: 206549 - protein, 39 aa, Artificial Sequence
  Description of Artificial Sequence: Synthetic polypeptide
DEAAISTTNPVATEQYGQCVCSVWGEDHNAENFNSENQA

SEQ ID NO: 206550 - protein, 39 aa, Artificial Sequence
  Description of Artificial Sequence: Synthetic polypeptide
TDEEISTTNPVATEQYGQCVCSNWGEDHNAENFNSDTQA

SEQ ID NO: 206551 - protein, 39 aa, Artificial Sequence
  Description of Artificial Sequence: Synthetic polypeptide
DEAEIRTTNPVAYEQYGQCSCSNWPEDDNQENFDSDTQS

SEQ ID NO: 206552 - protein, 37 aa, Artificial Sequence
  Description of Artificial Sequence: Synthetic polypeptide
DEDEIACTNPVATEQWGCIITAAAGGVDAPMNPNGPE

SEQ ID NO: 206553 - protein, 38 aa, Artificial Sequence
  Description of Artificial Sequence: Synthetic polypeptide
MEEEIRGTNPVATDQYGVVVGMGVPGQGNDQGDDTEGG

SEQ ID NO: 206554 - protein, 34 aa, Artificial Sequence
  Description of Artificial Sequence: Synthetic polypeptide
QEGEIACTNPCSYEQWGITCYCNDQQDHGDIVRG

SEQ ID NO: 206555 - protein, 36 aa, Artificial Sequence
  Description of Artificial Sequence: Synthetic polypeptide
DETEIRTTNPIATECWGATTWSNAEDWDAEPKGPYI

SEQ ID NO: 206556 - protein, 35 aa, Artificial Sequence
  Description of Artificial Sequence: Synthetic polypeptide
DETEIRTTNPIATECWGATTWANAEDWAEPKKTYI

SEQ ID NO: 206557 - protein, 34 aa, Artificial Sequence
  Description of Artificial Sequence: Synthetic polypeptide
QEGEIACTNPCSYEQWGITCYCNDQQDHGDTSRA

SEQ ID NO: 206558 - protein, 35 aa, Artificial Sequence
  Description of Artificial Sequence: Synthetic polypeptide
DETEIRTTNPIATECWGATTWANAEDWAEPKKPYI

SEQ ID NO: 206559 - protein, 38 aa, Artificial Sequence
  Description of Artificial Sequence: Synthetic polypeptide
CEEEIATTNPVAYEPQWGQACSMANPMQPQEHQDGTMK

SEQ ID NO: 206560 - protein, 38 aa, Artificial Sequence
  Description of Artificial Sequence: Synthetic polypeptide
DEGEIATTNPVATEQWGCVVATGGHQLDEATPDDQLHQ

SEQ ID NO: 206561 - protein, 36 aa, Artificial Sequence
  Description of Artificial Sequence: Synthetic polypeptide
DETEIRTTNPIATECWGATTWANAEDIAEPKGPYIL

SEQ ID NO: 206562 - protein, 35 aa, Artificial Sequence
  Description of Artificial Sequence: Synthetic polypeptide
DETEIRTTNPIATHCWGATTWANAEDWAEPKGKYI

SEQ ID NO: 206563 - protein, 35 aa, Artificial Sequence
  Description of Artificial Sequence: Synthetic polypeptide
DETEIRTTNPIATSCWGATTWANAEDWAEDKGPYI

SEQ ID NO: 206564 - protein, 36 aa, Artificial Sequence
  Description of Artificial Sequence: Synthetic polypeptide
DETEIRTTNPIATECWGATTWANAEDHWAEPKGPYI

SEQ ID NO: 206565 - protein, 35 aa, Artificial Sequence
  Description of Artificial Sequence: Synthetic polypeptide
DETEIRTTNPIATSCWGATTWINAEDWAEPKGPYI

SEQ ID NO: 206566 - protein, 36 aa, Artificial Sequence
  Description of Artificial Sequence: Synthetic polypeptide
DETEIRTTNPIATECWGATTWANAEDHCAEPKGPYI

SEQ ID NO: 206567 - protein, 36 aa, Artificial Sequence
  Description of Artificial Sequence: Synthetic polypeptide
DETEIRTTNPIATECWGATTWANAEDGWAEPKGPYI

SEQ ID NO: 206568 - protein, 38 aa, Artificial Sequence
  Description of Artificial Sequence: Synthetic polypeptide
TEEEIETTNPVAYECYGTVQACTGYEGQQNKTFGGQIE

SEQ ID NO: 206569 - protein, 36 aa, Artificial Sequence
  Description of Artificial Sequence: Synthetic polypeptide
DETEIRTTNPIAWECWGATSWANAEDWGEEPQEPQI

SEQ ID NO: 206570 - protein, 35 aa, Artificial Sequence
  Description of Artificial Sequence: Synthetic polypeptide
DETEIRTTNPIAYECWGATTPACAEHWAEPTGPNI

SEQ ID NO: 206571 - protein, 36 aa, Artificial Sequence
  Description of Artificial Sequence: Synthetic polypeptide
DETEIRTTNPIATECWGATTWANAEDGAEWKGFPYI

SEQ ID NO: 206572 - protein, 35 aa, Artificial Sequence
  Description of Artificial Sequence: Synthetic polypeptide
DETEIRTTNPIAYECWGATTPANATDWAGPKGPYL

SEQ ID NO: 206573 - protein, 35 aa, Artificial Sequence
  Description of Artificial Sequence: Synthetic polypeptide
DETEIRTTNPIAYECWGATTWANAEDWAEPKGPTI

SEQ ID NO: 206574 - protein, 36 aa, Artificial Sequence
  Description of Artificial Sequence: Synthetic polypeptide
DETEIRTTNPIATECWGATTWANAEDFWAEPKGPYI

SEQ ID NO: 206575 - protein, 35 aa, Artificial Sequence
  Description of Artificial Sequence: Synthetic polypeptide
DETEIRTTNPIAYECWGATTWANAEDWAEPKGPYI

SEQ ID NO: 206576 - protein, 36 aa, Artificial Sequence
  Description of Artificial Sequence: Synthetic polypeptide
SEVEIATTNPVATAQWGCVAGPTGEPGDEHNIDQPE

SEQ ID NO: 206577 - protein, 35 aa, Artificial Sequence
  Description of Artificial Sequence: Synthetic polypeptide
DETEIRTTNPIAYECWGATTWANNEDGAEPKGPTD

SEQ ID NO: 206578 - protein, 36 aa, Artificial Sequence
  Description of Artificial Sequence: Synthetic polypeptide
DETEIRTTNPIATECWGATTWANAEDFAEPKGPPYI

SEQ ID NO: 206579 - protein, 35 aa, Artificial Sequence
  Description of Artificial Sequence: Synthetic polypeptide
DETEIRTTNPIATECWGATTWANAEDFAEPKCPYI

SEQ ID NO: 206580 - protein, 36 aa, Artificial Sequence
  Description of Artificial Sequence: Synthetic polypeptide
DETEIRTTNPIATECWGATTWANAEDEWAEPKGPYI

SEQ ID NO: 206581 - protein, 37 aa, Artificial Sequence
  Description of Artificial Sequence: Synthetic polypeptide
DEACIRTTNPCAYEQFGCVCSNWGEDNQESFGSDTQS

SEQ ID NO: 206582 - protein, 36 aa, Artificial Sequence
  Description of Artificial Sequence: Synthetic polypeptide
DETEIRTTNPIATECWGATTWANAEDDWAEPKGPYI

SEQ ID NO: 206583 - protein, 36 aa, Artificial Sequence
  Description of Artificial Sequence: Synthetic polypeptide
DETEIRTTNPIATECWGATTWANAEDDVAEPKGPYI

SEQ ID NO: 206584 - protein, 36 aa, Artificial Sequence
  Description of Artificial Sequence: Synthetic polypeptide
DETEIRTTNPIATECWGATTWANAEDIWAEGKGPYI

SEQ ID NO: 206585 - protein, 36 aa, Artificial Sequence
  Description of Artificial Sequence: Synthetic polypeptide
DETEIRTTNPIATECWGATTWANAEDIWAEPKGKYI

SEQ ID NO: 206586 - protein, 36 aa, Artificial Sequence
  Description of Artificial Sequence: Synthetic polypeptide
DETEIRTTNPIATECWGATTWANAEDIWAEPKGPYI

SEQ ID NO: 206587 - protein, 34 aa, Artificial Sequence
  Description of Artificial Sequence: Synthetic polypeptide
DDTEIASTNPIATECWGATTWAANETWAEPVGPR

SEQ ID NO: 206588 - protein, 37 aa, Artificial Sequence
  Description of Artificial Sequence: Synthetic polypeptide
DAAEIATTNPVAYEQWGTCSAGTGPAGTNPHGDEGMK

SEQ ID NO: 206589 - protein, 37 aa, Artificial Sequence
  Description of Artificial Sequence: Synthetic polypeptide
SEYEIRCTNPVATEQYGQCVCGWGEHNAEHFISDTQS

SEQ ID NO: 206590 - protein, 37 aa, Artificial Sequence
  Description of Artificial Sequence: Synthetic polypeptide
LENAICTTNPVATEQYGQCFETVTLNNNFAETSGVQD

SEQ ID NO: 206591 - protein, 38 aa, Artificial Sequence
  Description of Artificial Sequence: Synthetic polypeptide
SEYEIRCTNPVATEQYGQCVCENWGEHNIEHFGSDTQA

SEQ ID NO: 206592 - protein, 36 aa, Artificial Sequence
  Description of Artificial Sequence: Synthetic polypeptide
DETEIRTTNPIATECWGATTWANAEDSWAEPKGPYI

SEQ ID NO: 206593 - protein, 35 aa, Artificial Sequence
  Description of Artificial Sequence: Synthetic polypeptide
DETEIRTTNPIATECWGATTWANAEDSAEPKPPYI

SEQ ID NO: 206594 - protein, 38 aa, Artificial Sequence
  Description of Artificial Sequence: Synthetic polypeptide
DEECISTVNPVATEGYGICVCSNWGEHNEENFNSDTQS

SEQ ID NO: 206595 - protein, 37 aa, Artificial Sequence
  Description of Artificial Sequence: Synthetic polypeptide
DETEIRTTNPIATECWGATTWANAEDRQAEPKGPYIF

SEQ ID NO: 206596 - protein, 38 aa, Artificial Sequence
  Description of Artificial Sequence: Synthetic polypeptide
DAAEIATTNPVAYEQWGCNVVTTNGNNIEAPRNQNGMD

SEQ ID NO: 206597 - protein, 36 aa, Artificial Sequence
  Description of Artificial Sequence: Synthetic polypeptide
DETEIRTTNPIATERWGATTWANAEDWAEPKGPYIS

SEQ ID NO: 206598 - protein, 38 aa, Artificial Sequence
  Description of Artificial Sequence: Synthetic polypeptide
DEGEIATTNPVATEQWGCVVATGGHQLDEATPDDQTAM

SEQ ID NO: 206599 - protein, 35 aa, Artificial Sequence
  Description of Artificial Sequence: Synthetic polypeptide
DETEIRTTNPIATERWGATTWANAEMWAEPKVPYI

SEQ ID NO: 206600 - protein, 38 aa, Artificial Sequence
  Description of Artificial Sequence: Synthetic polypeptide
DEACIRTTNPLATEQFGCVCSNWGEDDNAESFNSDTQS

SEQ ID NO: 206601 - protein, 35 aa, Artificial Sequence
  Description of Artificial Sequence: Synthetic polypeptide
DETEIRTTNPIATESWGATTWAKAEDWAEPKGPYI

SEQ ID NO: 206602 - protein, 36 aa, Artificial Sequence
  Description of Artificial Sequence: Synthetic polypeptide
DETEIRTTNPIATECWGATTWANAEDPWAEPKGPYI

SEQ ID NO: 206603 - protein, 35 aa, Artificial Sequence
  Description of Artificial Sequence: Synthetic polypeptide
DETEIRTTNPIATESWGATTWANAEDWAEPKEPYI

SEQ ID NO: 206604 - protein, 36 aa, Artificial Sequence
  Description of Artificial Sequence: Synthetic polypeptide
DETEIRTTNPIATECWGATTWANAEDNWAEPKGPYI

SEQ ID NO: 206605 - protein, 36 aa, Artificial Sequence
  Description of Artificial Sequence: Synthetic polypeptide
DETEIRTTNPIATECWGATTWANAEDNWAEPKGPMI

SEQ ID NO: 206606 - protein, 36 aa, Artificial Sequence
  Description of Artificial Sequence: Synthetic polypeptide
DETEIRTTNPIATECWGATTWANAEDNTAEPKGIYI

SEQ ID NO: 206607 - protein, 35 aa, Artificial Sequence
  Description of Artificial Sequence: Synthetic polypeptide
DETEIRTTNPIATESWGATTWANAEDWAEPKMPYI

SEQ ID NO: 206608 - protein, 36 aa, Artificial Sequence
  Description of Artificial Sequence: Synthetic polypeptide
DETEIRTTNPIATECWGATTWANAEDMWAEPKGPYI

SEQ ID NO: 206609 - protein, 36 aa, Artificial Sequence
  Description of Artificial Sequence: Synthetic polypeptide
DETEIRTTNPIATECWGATTWANAEDKWAEPKGPYI

SEQ ID NO: 206610 - protein, 36 aa, Artificial Sequence
  Description of Artificial Sequence: Synthetic polypeptide
DETEIRTTNPIATECWGATTWANAEDKWAEPKGAYI

SEQ ID NO: 206611 - protein, 36 aa, Artificial Sequence
  Description of Artificial Sequence: Synthetic polypeptide
DETEIRTTNPIATECWGATTWANAEDKWAAPKGPYI

SEQ ID NO: 206612 - protein, 36 aa, Artificial Sequence
  Description of Artificial Sequence: Synthetic polypeptide
DETEIRTTNPIATEYWGATTWANAEDWHAEPKGPYI

SEQ ID NO: 206613 - protein, 36 aa, Artificial Sequence
  Description of Artificial Sequence: Synthetic polypeptide
DETEIRTTNPIATEYWGATTWANAEDWKAEPKGPYI

SEQ ID NO: 206614 - protein, 36 aa, Artificial Sequence
  Description of Artificial Sequence: Synthetic polypeptide
DETEIRTTNPIATECWGATTWANAEDPWAEPKGPYW

SEQ ID NO: 206615 - protein, 36 aa, Artificial Sequence
  Description of Artificial Sequence: Synthetic polypeptide
DETEIRTTNPIATECWGATTWANAEDTWAEPKGPYI

SEQ ID NO: 206616 - protein, 36 aa, Artificial Sequence
  Description of Artificial Sequence: Synthetic polypeptide
DETEIRTTNPIATECWGATTWANAEDCWVEPKGPYI

SEQ ID NO: 206617 - protein, 36 aa, Artificial Sequence
  Description of Artificial Sequence: Synthetic polypeptide
DETEIRTTNPIATECWGATTWANAEDCWAEPKGPYG

SEQ ID NO: 206618 - protein, 35 aa, Artificial Sequence
  Description of Artificial Sequence: Synthetic polypeptide
DETEIRTTNPIATECWGATTWAGAEDWAEPKGPYP

SEQ ID NO: 206619 - protein, 38 aa, Artificial Sequence
  Description of Artificial Sequence: Synthetic polypeptide
SETAEIACTNPVAYEQWGTVAITNPLPEAPGNQNPKQS

SEQ ID NO: 206620 - protein, 35 aa, Artificial Sequence
  Description of Artificial Sequence: Synthetic polypeptide
DETEIRTTNPIATECWGATTWAGAEDWAEPKGPYI

SEQ ID NO: 206621 - protein, 37 aa, Artificial Sequence
  Description of Artificial Sequence: Synthetic polypeptide
SETAEIACTNPVAYEQWGSVSMSGNPGNPAGGDGSLD

SEQ ID NO: 206622 - protein, 35 aa, Artificial Sequence
  Description of Artificial Sequence: Synthetic polypeptide
DETEIRTTNPIATECWGATTWAFAEDWAEPKGPYI

SEQ ID NO: 206623 - protein, 35 aa, Artificial Sequence
  Description of Artificial Sequence: Synthetic polypeptide
DETEIRTTNPIATECWGATTWAEAEDWAEPKGPYI

SEQ ID NO: 206624 - protein, 38 aa, Artificial Sequence
  Description of Artificial Sequence: Synthetic polypeptide
SETAEIACTNPVAYEQWGSVAIANPLPEAPGNQNPNQQ

SEQ ID NO: 206625 - protein, 35 aa, Artificial Sequence
  Description of Artificial Sequence: Synthetic polypeptide
DETEIRTTNPIATECWGATTWADAEDWAEPKGPYI

SEQ ID NO: 206626 - protein, 35 aa, Artificial Sequence
  Description of Artificial Sequence: Synthetic polypeptide
DETEIRTTNPIATECWGATTWACAEDWAEPTGSYI

SEQ ID NO: 206627 - protein, 35 aa, Artificial Sequence
  Description of Artificial Sequence: Synthetic polypeptide
DETEIRTTNPIATECWGATTWACAEDWAEPNGPYI

SEQ ID NO: 206628 - protein, 35 aa, Artificial Sequence
  Description of Artificial Sequence: Synthetic polypeptide
DETEIRTTNPIATECWGATTWACAEDWAEPLGPYI

SEQ ID NO: 206629 - protein, 37 aa, Artificial Sequence
  Description of Artificial Sequence: Synthetic polypeptide
DENEIRCTNPVSTEGYGCICSNWEEDNAENFNSDNQS

SEQ ID NO: 206630 - protein, 35 aa, Artificial Sequence
  Description of Artificial Sequence: Synthetic polypeptide
DETEIRTTNPIATECWGATTWACAEDWAEPKGTYI

SEQ ID NO: 206631 - protein, 35 aa, Artificial Sequence
  Description of Artificial Sequence: Synthetic polypeptide
DETEIRTTNPIATECWGATTWACAEDWAEPKGPYI

SEQ ID NO: 206632 - protein, 38 aa, Artificial Sequence
  Description of Artificial Sequence: Synthetic polypeptide
LDNYMIRCTNPVATEQYGSVFIVSWAEDIWEGQMEWWT

SEQ ID NO: 206633 - protein, 38 aa, Artificial Sequence
  Description of Artificial Sequence: Synthetic polypeptide
QAEEIATTNPVAYEQYGSVCAMANHADDSKAPGDSFEN

SEQ ID NO: 206634 - protein, 35 aa, Artificial Sequence
  Description of Artificial Sequence: Synthetic polypeptide
DETEIRTTNPIATECWGATTWAAEDWWAEPKGPYI

SEQ ID NO: 206635 - protein, 39 aa, Artificial Sequence
  Description of Artificial Sequence: Synthetic polypeptide
DEAEIRTTNPVAYEQYYYSLPNKPNVDMMNFQSMQDCEW

SEQ ID NO: 206636 - protein, 36 aa, Artificial Sequence
  Description of Artificial Sequence: Synthetic polypeptide
SESEIRTTNPVSTEPWGCIAPEDGQQQQQQRTGTKI

SEQ ID NO: 206637 - protein, 37 aa, Artificial Sequence
  Description of Artificial Sequence: Synthetic polypeptide
DETEIRTTNPTATECWGVATTPANATDGWPEPKGPYP

SEQ ID NO: 206638 - protein, 38 aa, Artificial Sequence
  Description of Artificial Sequence: Synthetic polypeptide
SESEIRTTNPVATEQWGYCYNPETIPLEEFREEEIHED

SEQ ID NO: 206639 - protein, 38 aa, Artificial Sequence
  Description of Artificial Sequence: Synthetic polypeptide
DEACIRTTNPVATEIYGCVCQNWGEDDNAEYFGSDTQS

SEQ ID NO: 206640 - protein, 38 aa, Artificial Sequence
  Description of Artificial Sequence: Synthetic polypeptide
DEACIRTTNPVATEIYGICVCGNWGEDNAENFGSDTQS

SEQ ID NO: 206641 - protein, 35 aa, Artificial Sequence
  Description of Artificial Sequence: Synthetic polypeptide
DETEIRTTNPIATECWGATTWAAEDEAEPKGGPYI

SEQ ID NO: 206642 - protein, 35 aa, Artificial Sequence
  Description of Artificial Sequence: Synthetic polypeptide
DETEIRTTNPIATECWGATTWAAAMDWAEGEGPYI

SEQ ID NO: 206643 - protein, 35 aa, Artificial Sequence
  Description of Artificial Sequence: Synthetic polypeptide
DETEIRTTNPIATECWGATTWAHAEDWAEPHGPYI

SEQ ID NO: 206644 - protein, 35 aa, Artificial Sequence
  Description of Artificial Sequence: Synthetic polypeptide
DETEIRTTNPIATECWGATTWAHAEDWAEPKGPYI

SEQ ID NO: 206645 - protein, 35 aa, Artificial Sequence
  Description of Artificial Sequence: Synthetic polypeptide
DETEIRTTNPIATECWGATTWAHAEDWKEPKGPYI

SEQ ID NO: 206646 - protein, 35 aa, Artificial Sequence
  Description of Artificial Sequence: Synthetic polypeptide
DETEIRTTNPIATECWGATTWAIAEDWAEPKGPYI

SEQ ID NO: 206647 - protein, 35 aa, Artificial Sequence
  Description of Artificial Sequence: Synthetic polypeptide
DETEIRTTNPIAYECWGATTWNNNEDGAEPKGPEI

SEQ ID NO: 206648 - protein, 36 aa, Artificial Sequence
  Description of Artificial Sequence: Synthetic polypeptide
DETEIRTTNPIATECWGATTWANAEDAWAEPKGPYI

SEQ ID NO: 206649 - protein, 36 aa, Artificial Sequence
  Description of Artificial Sequence: Synthetic polypeptide
DETEIRTTNPIAYECWGATTWTNANDWEEPQEPQIE

SEQ ID NO: 206650 - protein, 35 aa, Artificial Sequence
  Description of Artificial Sequence: Synthetic polypeptide
DETEIRTTNPIAYEPWGATTPACSEHWAEPTGPYI

SEQ ID NO: 206651 - protein, 36 aa, Artificial Sequence
  Description of Artificial Sequence: Synthetic polypeptide
DETEIRTTNPIATECWGATTWANAECWAEPKGPYIH

SEQ ID NO: 206652 - protein, 35 aa, Artificial Sequence
  Description of Artificial Sequence: Synthetic polypeptide
SETEIRTTNPIATECWGATTWANAEDWSEPKGPYI

SEQ ID NO: 206653 - protein, 35 aa, Artificial Sequence
  Description of Artificial Sequence: Synthetic polypeptide
SETEIRTTNPIATECWGATTWANAEDWAEPKGPYI

SEQ ID NO: 206654 - protein, 35 aa, Artificial Sequence
  Description of Artificial Sequence: Synthetic polypeptide
DETEIRTTNPISTECWGATTWANAEDIAEPKGPYI

SEQ ID NO: 206655 - protein, 36 aa, Artificial Sequence
  Description of Artificial Sequence: Synthetic polypeptide
DETEIRTTNPIATECWGATTWANAEASWAEPKGPYI

SEQ ID NO: 206656 - protein, 35 aa, Artificial Sequence
  Description of Artificial Sequence: Synthetic polypeptide
DETEIRTTNPISTECWGATTWANAKDWAEPKGPYI

SEQ ID NO: 206657 - protein, 35 aa, Artificial Sequence
  Description of Artificial Sequence: Synthetic polypeptide
DETEIRTTNPISTECWGATTWSNMEDWAEPKGPYI

SEQ ID NO: 206658 - protein, 36 aa, Artificial Sequence
  Description of Artificial Sequence: Synthetic polypeptide
DETEIRTTNPIATECWGATTWANADDWAEPKGVPYI

SEQ ID NO: 206659 - protein, 36 aa, Artificial Sequence
  Description of Artificial Sequence: Synthetic polypeptide
DETEIRTTNPIATECWGATTWANAEDCWAEPKGPYI

SEQ ID NO: 206660 - protein, 35 aa, Artificial Sequence
  Description of Artificial Sequence: Synthetic polypeptide
DETEIRTTNPISTECWGATVWAAAEDWAEPKGPYI

SEQ ID NO: 206661 - protein, 35 aa, Artificial Sequence
  Description of Artificial Sequence: Synthetic polypeptide
DETEIRTTNPISTECWGTTIWSNMEDWAEPKGPYI

SEQ ID NO: 206662 - protein, 36 aa, Artificial Sequence
  Description of Artificial Sequence: Synthetic polypeptide
DETEIRTTNPIATECWGATTWANACDWAEPKGPYIH

SEQ ID NO: 206663 - protein, 36 aa, Artificial Sequence
  Description of Artificial Sequence: Synthetic polypeptide
DETEIRTTNPISTEPWGATTWANAEDIQAEQKGPYI

SEQ ID NO: 206664 - protein, 36 aa, Artificial Sequence
  Description of Artificial Sequence: Synthetic polypeptide
DETEIRTTNPISTEPWGATTWANAEDIQAEQNGPYI

SEQ ID NO: 206665 - protein, 35 aa, Artificial Sequence
  Description of Artificial Sequence: Synthetic polypeptide
DETEIRTTNPISTEPWGATTWANAEDWAEPKGPYI

SEQ ID NO: 206666 - protein, 36 aa, Artificial Sequence
  Description of Artificial Sequence: Synthetic polypeptide
DETEIRTTNPIATECWGATTWANAADWAEPDGTPYI

SEQ ID NO: 206667 - protein, 36 aa, Artificial Sequence
  Description of Artificial Sequence: Synthetic polypeptide
DETEIRTTNPIATECWGATTWANAADNWAEPAGPYI

SEQ ID NO: 206668 - protein, 36 aa, Artificial Sequence
  Description of Artificial Sequence: Synthetic polypeptide
DETEIRTTNPIATECWGATTWANAADGWAEPKGPII

SEQ ID NO: 206669 - protein, 35 aa, Artificial Sequence
  Description of Artificial Sequence: Synthetic polypeptide
DETEIRTTNPIATECWGATTWAMAEDWAESKGPYI

SEQ ID NO: 206670 - protein, 35 aa, Artificial Sequence
  Description of Artificial Sequence: Synthetic polypeptide
DETEIRTTNPIATECWGATTWAMAEDWAEPKGPYI

SEQ ID NO: 206671 - protein, 35 aa, Artificial Sequence
  Description of Artificial Sequence: Synthetic polypeptide
DETEIRTTNPIATECWGATTWAKAEDWAEPKGPAI

SEQ ID NO: 206672 - protein, 35 aa, Artificial Sequence
  Description of Artificial Sequence: Synthetic polypeptide
DETEIRTTNPIATECWGATTWAKAEDWAENKGPYI

SEQ ID NO: 206673 - protein, 37 aa, Artificial Sequence
  Description of Artificial Sequence: Synthetic polypeptide
DAAEIATTNPVAYEQWGCNVANMNHVEAQDGPEDDHW

SEQ ID NO: 206674 - protein, 40 aa, Artificial Sequence
  Description of Artificial Sequence: Synthetic polypeptide
SEEEISTTNPVATEQYGQCQVCSNWGEDHNAENFNSDFQS

SEQ ID NO: 206675 - protein, 38 aa, Artificial Sequence
  Description of Artificial Sequence: Synthetic polypeptide
CEEEIATTNPVAYEQPYGTNPSGGGGPTNDAGDDQAAE

SEQ ID NO: 206676 - protein, 36 aa, Artificial Sequence
  Description of Artificial Sequence: Synthetic polypeptide
DETEIRTTNPIATECWGATTWANAEDVKAEPKGPYI

SEQ ID NO: 206677 - protein, 36 aa, Artificial Sequence
  Description of Artificial Sequence: Synthetic polypeptide
DETEIRTTNPIATECWGATTWANAEDWAEPKGPYIH

SEQ ID NO: 206678 - protein, 36 aa, Artificial Sequence
  Description of Artificial Sequence: Synthetic polypeptide
DETEIRTTNPIATECWGATTWANAEDWAEPKGPYIG

SEQ ID NO: 206679 - protein, 36 aa, Artificial Sequence
  Description of Artificial Sequence: Synthetic polypeptide
DETEIRTTNPIATECWGATTWANAEDWAEPKGPYIF

SEQ ID NO: 206680 - protein, 36 aa, Artificial Sequence
  Description of Artificial Sequence: Synthetic polypeptide
DETEIRTTNPIATECWGATTWANAEDWAEPKGPYIE

SEQ ID NO: 206681 - protein, 36 aa, Artificial Sequence
  Description of Artificial Sequence: Synthetic polypeptide
DETEIRTTNPIATECWGATTWANAEDWAEPKGPYID

SEQ ID NO: 206682 - protein, 37 aa, Artificial Sequence
  Description of Artificial Sequence: Synthetic polypeptide
DAAEIATTNPVAYEQWGTTSSSGDGPAGNMHGMEAGM

SEQ ID NO: 206683 - protein, 36 aa, Artificial Sequence
  Description of Artificial Sequence: Synthetic polypeptide
DETEIRTTNPIATECWGATTWANAEDWAEPKGPYIC

SEQ ID NO: 206684 - protein, 36 aa, Artificial Sequence
  Description of Artificial Sequence: Synthetic polypeptide
DETEIRTTNPIATECWGATTWANAEDWAEPKGPYIA

SEQ ID NO: 206685 - protein, 36 aa, Artificial Sequence
  Description of Artificial Sequence: Synthetic polypeptide
DAAEIATTNPVAYEQWGTTSSSGDGPAGDPHGMAGM

SEQ ID NO: 206686 - protein, 36 aa, Artificial Sequence
  Description of Artificial Sequence: Synthetic polypeptide
DETEIRTTNPIATECWGATTWANAEDWAEPKGPYHT

SEQ ID NO: 206687 - protein, 36 aa, Artificial Sequence
  Description of Artificial Sequence: Synthetic polypeptide
DAAEIATTNPVAYEQWGTTSSGDGPAGNPEGNPAEQ

SEQ ID NO: 206688 - protein, 39 aa, Artificial Sequence
  Description of Artificial Sequence: Synthetic polypeptide
SQEEIRTTNPVATEQWGQCVCSNWGEPHNAENFGSDTQA

SEQ ID NO: 206689 - protein, 38 aa, Artificial Sequence
  Description of Artificial Sequence: Synthetic polypeptide
SQEEIRTTNPVATEQWGQCVCSNWGEHNQENFISDTQA

SEQ ID NO: 206690 - protein, 36 aa, Artificial Sequence
  Description of Artificial Sequence: Synthetic polypeptide
DETEIRTTNPIATECWGVTTPACAEDEWAEPTGPYQ

SEQ ID NO: 206691 - protein, 36 aa, Artificial Sequence
  Description of Artificial Sequence: Synthetic polypeptide
DETEIRTTNPIATECWGATTWANAEDWAEPKGPVIS

SEQ ID NO: 206692 - protein, 36 aa, Artificial Sequence
  Description of Artificial Sequence: Synthetic polypeptide
DETEIRTTNPIATECWGWHTTWAHAEDWPDPKGPYI

SEQ ID NO: 206693 - protein, 36 aa, Artificial Sequence
  Description of Artificial Sequence: Synthetic polypeptide
DETEIRTTNPIATECWGWTTWANAEDWVAEPKGPYI

SEQ ID NO: 206694 - protein, 36 aa, Artificial Sequence
  Description of Artificial Sequence: Synthetic polypeptide
DETEIRTTNPIATECWGATTWANAEDWAEPKGPPYI

SEQ ID NO: 206695 - protein, 36 aa, Artificial Sequence
  Description of Artificial Sequence: Synthetic polypeptide
DAAEIATTNPVAYEQWGTTSSGAGPAGNPHGDTGME

SEQ ID NO: 206696 - protein, 38 aa, Artificial Sequence
  Description of Artificial Sequence: Synthetic polypeptide
DEECLRTTNPCAYEQYGCVCSNWGEAHNQENFGSDTQS

SEQ ID NO: 206697 - protein, 36 aa, Artificial Sequence
  Description of Artificial Sequence: Synthetic polypeptide
DETEIRTTNPIATECWGATTWANAEDWAEPKGPLIF

SEQ ID NO: 206698 - protein, 36 aa, Artificial Sequence
  Description of Artificial Sequence: Synthetic polypeptide
DETEIRTTNPIATECWGATTWANAEDWAEPKGPIIH

SEQ ID NO: 206699 - protein, 36 aa, Artificial Sequence
  Description of Artificial Sequence: Synthetic polypeptide
DETEIRTTNPIATECWGATTWANAEDWAEPKGPGIG

SEQ ID NO: 206700 - protein, 35 aa, Artificial Sequence
  Description of Artificial Sequence: Synthetic polypeptide
DETEIRTTNPIATEEWGATTWWIAEDWAEPKGPYI

SEQ ID NO: 206701 - protein, 36 aa, Artificial Sequence
  Description of Artificial Sequence: Synthetic polypeptide
DETEIRTTNPIATECWGATTWANAEDWAEPKGMPYI

SEQ ID NO: 206702 - protein, 36 aa, Artificial Sequence
  Description of Artificial Sequence: Synthetic polypeptide
DETEIRTTNPIATECWGATTWANAEDWAEPKGPYII

SEQ ID NO: 206703 - protein, 36 aa, Artificial Sequence
  Description of Artificial Sequence: Synthetic polypeptide
DETEIRTTNPIATECWGATTWANAEDWAEPKGPYIK

SEQ ID NO: 206704 - protein, 36 aa, Artificial Sequence
  Description of Artificial Sequence: Synthetic polypeptide
DETEIRTTNPIATECWGATTWANAEDWAEPKGPYIL

SEQ ID NO: 206705 - protein, 36 aa, Artificial Sequence
  Description of Artificial Sequence: Synthetic polypeptide
DETEIRTTNPIATECWGATTWANAEDWAEPKGPYIM

SEQ ID NO: 206706 - protein, 35 aa, Artificial Sequence
  Description of Artificial Sequence: Synthetic polypeptide
DETEIRTTNPIATECWGATTWANAEDWAEPKKPYH

SEQ ID NO: 206707 - protein, 35 aa, Artificial Sequence
  Description of Artificial Sequence: Synthetic polypeptide
DETEIRTTNPIATECWGATTWANAEDWAEPKIPYI

SEQ ID NO: 206708 - protein, 35 aa, Artificial Sequence
  Description of Artificial Sequence: Synthetic polypeptide
DETEIRTTNPIATECWGATTWANAEDWAEPKHPYI

SEQ ID NO: 206709 - protein, 36 aa, Artificial Sequence
  Description of Artificial Sequence: Synthetic polypeptide
DETEIRTTNPIATECWGATTWANAEDWAEPKGYPYI

SEQ ID NO: 206710 - protein, 36 aa, Artificial Sequence
  Description of Artificial Sequence: Synthetic polypeptide
DETEIRTTNPIATECWGRTTWANAEDWEAEPKGPYI

SEQ ID NO: 206711 - protein, 36 aa, Artificial Sequence
  Description of Artificial Sequence: Synthetic polypeptide
DETEIRTTNPIATECWGATTWANAEDWAEPKGYGYI

SEQ ID NO: 206712 - protein, 38 aa, Artificial Sequence
  Description of Artificial Sequence: Synthetic polypeptide
MEDEIRCTNPVATEIYGTVDTSVDGGGGEEGGGQENGQ

SEQ ID NO: 206713 - protein, 36 aa, Artificial Sequence
  Description of Artificial Sequence: Synthetic polypeptide
DETEIRTTNPIATECWGATTWANAEDWAEPKGWPYI

SEQ ID NO: 206714 - protein, 36 aa, Artificial Sequence
  Description of Artificial Sequence: Synthetic polypeptide
DETEIRTTNPIATECWGATTWANAEDWAEPKGVPYI

SEQ ID NO: 206715 - protein, 36 aa, Artificial Sequence
  Description of Artificial Sequence: Synthetic polypeptide
DETEIRTTNPIATECWGATTWANAEDWAEPKGTPYI

SEQ ID NO: 206716 - protein, 36 aa, Artificial Sequence
  Description of Artificial Sequence: Synthetic polypeptide
DETEIRTTNPIATECWGATTWANAEDWAEPKGSPYI

SEQ ID NO: 206717 - protein, 36 aa, Artificial Sequence
  Description of Artificial Sequence: Synthetic polypeptide
DETEIRTTNPIATECWGATTWANAEDWAEPKGRPYI

SEQ ID NO: 206718 - protein, 36 aa, Artificial Sequence
  Description of Artificial Sequence: Synthetic polypeptide
DETEIRTTNPIATECWGATTWANAEDWAEPKGLPYP

SEQ ID NO: 206719 - protein, 36 aa, Artificial Sequence
  Description of Artificial Sequence: Synthetic polypeptide
DETEIRTTNPIATECWGATTWANAEDWAEPKGQPYI

SEQ ID NO: 206720 - protein, 35 aa, Artificial Sequence
  Description of Artificial Sequence: Synthetic polypeptide
DETEIRTTNPIATECWGTTTPACAEDWAEPKGPYI

SEQ ID NO: 206721 - protein, 36 aa, Artificial Sequence
  Description of Artificial Sequence: Synthetic polypeptide
DETEIRTTNPIATECWGATTWANAEDWAEPKGPYQQ

SEQ ID NO: 206722 - protein, 35 aa, Artificial Sequence
  Description of Artificial Sequence: Synthetic polypeptide
DETEIRTTNPIATECWGTTTWANAEDWAEPKLPYI

SEQ ID NO: 206723 - protein, 36 aa, Artificial Sequence
  Description of Artificial Sequence: Synthetic polypeptide
DETEIRTTNPIATECWGATTWANAEDWAEPKGPYKF

SEQ ID NO: 206724 - protein, 36 aa, Artificial Sequence
  Description of Artificial Sequence: Synthetic polypeptide
DETEIRTTNPIATECWGATTWANAEDWAEPKGPYIY

SEQ ID NO: 206725 - protein, 36 aa, Artificial Sequence
  Description of Artificial Sequence: Synthetic polypeptide
DETEIRTTNPIATECWGATTWANAEDWAEPKGPYIW

SEQ ID NO: 206726 - protein, 36 aa, Artificial Sequence
  Description of Artificial Sequence: Synthetic polypeptide
DETEIRTTNPIATECWGATTWANAEDWAEPKGPYIV

SEQ ID NO: 206727 - protein, 36 aa, Artificial Sequence
  Description of Artificial Sequence: Synthetic polypeptide
DETEIRTTNPIATECWGATTWANAEDWAEPKGPYIT

SEQ ID NO: 206728 - protein, 36 aa, Artificial Sequence
  Description of Artificial Sequence: Synthetic polypeptide
DETEIRTTNPIATECWGATTWANAEDWAEPKGPYIS

SEQ ID NO: 206729 - protein, 36 aa, Artificial Sequence
  Description of Artificial Sequence: Synthetic polypeptide
DETEIRTTNPIATECWGATTWANAEDWAEPKGPYIQ

SEQ ID NO: 206730 - protein, 37 aa, Artificial Sequence
  Description of Artificial Sequence: Synthetic polypeptide
CEEVIACTNPVAYEQWGCSVIAQANGNNSAEQIGSLM

SEQ ID NO: 206731 - protein, 36 aa, Artificial Sequence
  Description of Artificial Sequence: Synthetic polypeptide
DETEIRTTNPIATECWGATTWANAEDWAEPKGPYIN

SEQ ID NO: 206732 - protein, 37 aa, Artificial Sequence
  Description of Artificial Sequence: Synthetic polypeptide
DETEIRTTNPIATECWGTAPTWANAEDWAEPKGPYID

SEQ ID NO: 206733 - protein, 37 aa, Artificial Sequence
  Description of Artificial Sequence: Synthetic polypeptide
SEYEIRCTNPVAYEQYGCVCGNWGEHNAEHFNSDTQS

SEQ ID NO: 206734 - protein, 36 aa, Artificial Sequence
  Description of Artificial Sequence: Synthetic polypeptide
DETEIRTTNPIATECWGATTWANAEDWAEPKGLPYI

SEQ ID NO: 206735 - protein, 36 aa, Artificial Sequence
  Description of Artificial Sequence: Synthetic polypeptide
DETEIRTTNPIATECWGATTWANAEDWAEPKGKPYI

SEQ ID NO: 206736 - protein, 39 aa, Artificial Sequence
  Description of Artificial Sequence: Synthetic polypeptide
SQAEIRTTNPVATEQWGQCVCSNWGEDHNAEYFGSDNQA

SEQ ID NO: 206737 - protein, 36 aa, Artificial Sequence
  Description of Artificial Sequence: Synthetic polypeptide
DETEIRTTNPIATENWGATTWANAEDWTAEPKGPYI

SEQ ID NO: 206738 - protein, 36 aa, Artificial Sequence
  Description of Artificial Sequence: Synthetic polypeptide
DETEIRTTNPIATECWGATTWANAEDWAEPEGPYII

SEQ ID NO: 206739 - protein, 38 aa, Artificial Sequence
  Description of Artificial Sequence: Synthetic polypeptide
SQAEIRTTNPVATEQWGCVCSNWGEDHNAEYFNSDTQA

SEQ ID NO: 206740 - protein, 36 aa, Artificial Sequence
  Description of Artificial Sequence: Synthetic polypeptide
DETEIRTTNPIATEPWGATTPACAEDQSAEPTGPYI

SEQ ID NO: 206741 - protein, 39 aa, Artificial Sequence
  Description of Artificial Sequence: Synthetic polypeptide
SNGEIRCTNPVATEQYGTCVNSATPNATEYEGHSVDQKE

SEQ ID NO: 206742 - protein, 36 aa, Artificial Sequence
  Description of Artificial Sequence: Synthetic polypeptide
DETEIRTTNPIATEPWGATTPACIVDWSAEPTGPYL

SEQ ID NO: 206743 - protein, 35 aa, Artificial Sequence
  Description of Artificial Sequence: Synthetic polypeptide
DETEIRTTNPIATEPWGATTWACAEDWAEPKGPYD

SEQ ID NO: 206744 - protein, 35 aa, Artificial Sequence
  Description of Artificial Sequence: Synthetic polypeptide
DETEIRTTNPIATECWGATTWANAEDWAEPAEPYI

SEQ ID NO: 206745 - protein, 35 aa, Artificial Sequence
  Description of Artificial Sequence: Synthetic polypeptide
DETEIRTTNPIATEPWGATTWAWAEDWAEPKGPYI

SEQ ID NO: 206746 - protein, 36 aa, Artificial Sequence
  Description of Artificial Sequence: Synthetic polypeptide
DETEIRTTNPIATECWGATTWANAEDWAEGKGPYIG

SEQ ID NO: 206747 - protein, 35 aa, Artificial Sequence
  Description of Artificial Sequence: Synthetic polypeptide
DETEIRTTNPIATEPWGQTTPACAEDWAEPTGPYI

SEQ ID NO: 206748 - protein, 37 aa, Artificial Sequence
  Description of Artificial Sequence: Synthetic polypeptide
DEATIRATNPVATEQYGSCFEPEVYWLPPKPEVELIE

SEQ ID NO: 206749 - protein, 37 aa, Artificial Sequence
  Description of Artificial Sequence: Synthetic polypeptide
DEECLRTTNPCAYEGYGQCVCSWGEHNQENFGSDTQA

SEQ ID NO: 206750 - protein, 36 aa, Artificial Sequence
  Description of Artificial Sequence: Synthetic polypeptide
DEGEIATTNPVATEQWGTNCAAGDGHPVEFEINEDD

SEQ ID NO: 206751 - protein, 36 aa, Artificial Sequence
  Description of Artificial Sequence: Synthetic polypeptide
DAAEIATTNPVAYEQWGTTSAGTGPAGNPHGDDEGM

SEQ ID NO: 206752 - protein, 36 aa, Artificial Sequence
  Description of Artificial Sequence: Synthetic polypeptide
DETEIRTTNPIATECWGATTWANAEDWAEDKGPYIH

SEQ ID NO: 206753 - protein, 35 aa, Artificial Sequence
  Description of Artificial Sequence: Synthetic polypeptide
DETEIRTTNPIATECWGATTWANAEDWADPKSPYI

SEQ ID NO: 206754 - protein, 39 aa, Artificial Sequence
  Description of Artificial Sequence: Synthetic polypeptide
ADEEIRTTNPVATEQYGQCVCGNWGEDHNAENFNSDNQI

SEQ ID NO: 206755 - protein, 36 aa, Artificial Sequence
  Description of Artificial Sequence: Synthetic polypeptide
DETEIRTTNPIATECWGATTWANAEDWADPKGPYIN

SEQ ID NO: 206756 - protein, 36 aa, Artificial Sequence
  Description of Artificial Sequence: Synthetic polypeptide
DAAEIATTNPVAYEQWGTTSAGPGPAGGIPHGDNGM

SEQ ID NO: 206757 - protein, 39 aa, Artificial Sequence
  Description of Artificial Sequence: Synthetic polypeptide
LENEIRTTNPVATEQYGAASCMCAGVDLLQEQTVQEDDN

SEQ ID NO: 206758 - protein, 37 aa, Artificial Sequence
  Description of Artificial Sequence: Synthetic polypeptide
DEECISTVNPVAYEGYGCVCSNWGEHNAENFGSDTQS

SEQ ID NO: 206759 - protein, 36 aa, Artificial Sequence
  Description of Artificial Sequence: Synthetic polypeptide
DETEIRTTNPIATECWGATTWANAEDWAAEPKGPYI

SEQ ID NO: 206760 - protein, 36 aa, Artificial Sequence
  Description of Artificial Sequence: Synthetic polypeptide
DETEIRTTNPIATECWGATTWANAEDVWAEPKGPYI

SEQ ID NO: 206761 - protein, 35 aa, Artificial Sequence
  Description of Artificial Sequence: Synthetic polypeptide
DETEIRTTNPIATECWGATTWANAEDWAEPHDPYI

SEQ ID NO: 206762 - protein, 36 aa, Artificial Sequence
  Description of Artificial Sequence: Synthetic polypeptide
DETEIRTTNPIATEKWGATTWANAEDWTAEPKGPYI

SEQ ID NO: 206763 - protein, 35 aa, Artificial Sequence
  Description of Artificial Sequence: Synthetic polypeptide
DETEIRTTNPIATECWGATTWANAEDWAEPKAPYI

SEQ ID NO: 206764 - protein, 35 aa, Artificial Sequence
  Description of Artificial Sequence: Synthetic polypeptide
DETEIRTTNPIATECWGATTWANAEDWAEPKCKYI

SEQ ID NO: 206765 - protein, 36 aa, Artificial Sequence
  Description of Artificial Sequence: Synthetic polypeptide
DETEIRTTNPIATECWGATTWANAEDWAEPKGIPYI

SEQ ID NO: 206766 - protein, 36 aa, Artificial Sequence
  Description of Artificial Sequence: Synthetic polypeptide
DETEIRTTNPIATECWGATTWANAEDWAEPKGHPYL

SEQ ID NO: 206767 - protein, 36 aa, Artificial Sequence
  Description of Artificial Sequence: Synthetic polypeptide
DETEIRTTNPIATECWGATTWANAEDWAEPKGHPYI

SEQ ID NO: 206768 - protein, 36 aa, Artificial Sequence
  Description of Artificial Sequence: Synthetic polypeptide
DETEIRTTNPIATECWGATTWANAEDWAEPKGGPYI

SEQ ID NO: 206769 - protein, 36 aa, Artificial Sequence
  Description of Artificial Sequence: Synthetic polypeptide
DETEIRTTNPIATECWGATTWANAEDWAEPKGGIYI

SEQ ID NO: 206770 - protein, 36 aa, Artificial Sequence
  Description of Artificial Sequence: Synthetic polypeptide
DETEIRTTNPIATEGWGATTWANAEDWYAEPKGPYI

SEQ ID NO: 206771 - protein, 39 aa, Artificial Sequence
  Description of Artificial Sequence: Synthetic polypeptide
DCEEIRTTNPVATEQWGYANVTQAVALETVAIVHSPERG

SEQ ID NO: 206772 - protein, 36 aa, Artificial Sequence
  Description of Artificial Sequence: Synthetic polypeptide
DETEIRTTNPIATECWGATTWANAEDWAEPKGFPYI

SEQ ID NO: 206773 - protein, 36 aa, Artificial Sequence
  Description of Artificial Sequence: Synthetic polypeptide
DETEIRTTNPIATECWGATTWANAEDWAEPKGEPYI

SEQ ID NO: 206774 - protein, 36 aa, Artificial Sequence
  Description of Artificial Sequence: Synthetic polypeptide
DETEIRTTNPIATECWGATTWANAEDWAEPKGDPYI

SEQ ID NO: 206775 - protein, 36 aa, Artificial Sequence
  Description of Artificial Sequence: Synthetic polypeptide
DETEIRTTNPIATEGWGCQTCANSEDDAENSGSETI

SEQ ID NO: 206776 - protein, 36 aa, Artificial Sequence
  Description of Artificial Sequence: Synthetic polypeptide
DETEIRTTNPIATEGWGCQTCENAEDDAENSGSETQ

SEQ ID NO: 206777 - protein, 36 aa, Artificial Sequence
  Description of Artificial Sequence: Synthetic polypeptide
DETEIRTTNPIATECWGATTWANAEDWAEPKGKPYQ

SEQ ID NO: 206778 - protein, 37 aa, Artificial Sequence
  Description of Artificial Sequence: Synthetic polypeptide
DETEIRTTNPIATEGWGCQTCFNSEDDAEHSGSDNQS

SEQ ID NO: 206779 - protein, 36 aa, Artificial Sequence
  Description of Artificial Sequence: Synthetic polypeptide
DETEIRTTNPIATECWGATTWANAEDWAEPKGCPYI

SEQ ID NO: 206780 - protein, 37 aa, Artificial Sequence
  Description of Artificial Sequence: Synthetic polypeptide
DETEIRTTNPIATEGWGCQTCQNSEDDNAENSGSETQ

SEQ ID NO: 206781 - protein, 37 aa, Artificial Sequence
  Description of Artificial Sequence: Synthetic polypeptide
DETEIRTTNPIATEGWGCQTCQNWEADAENSGSDNIS

SEQ ID NO: 206782 - protein, 36 aa, Artificial Sequence
  Description of Artificial Sequence: Synthetic polypeptide
DETEIRTTNPIATECWGATTWANAEDWAEPKGAPYL

SEQ ID NO: 206783 - protein, 36 aa, Artificial Sequence
  Description of Artificial Sequence: Synthetic polypeptide
DETEIRTTNPIATECWGATTWANAEDWAEPKGAPYI

SEQ ID NO: 206784 - protein, 35 aa, Artificial Sequence
  Description of Artificial Sequence: Synthetic polypeptide
DETEIRTTNPIATECWGATTWANAEDWAEPKFPYI

SEQ ID NO: 206785 - protein, 35 aa, Artificial Sequence
  Description of Artificial Sequence: Synthetic polypeptide
DETEIRTTNPIATECWGATTWANAEDWAEPKEPYI

SEQ ID NO: 206786 - protein, 35 aa, Artificial Sequence
  Description of Artificial Sequence: Synthetic polypeptide
DETEIRTTNPIATECWGATTWANAEDWAEPKEPYF

SEQ ID NO: 206787 - protein, 35 aa, Artificial Sequence
  Description of Artificial Sequence: Synthetic polypeptide
DETEIRTTNPIATECWGATTWANAEDWAEPKDPYI

SEQ ID NO: 206788 - protein, 35 aa, Artificial Sequence
  Description of Artificial Sequence: Synthetic polypeptide
DETEIRTTNPIATECWGATTWANAEDWAEPKDPDI

SEQ ID NO: 206789 - protein, 35 aa, Artificial Sequence
  Description of Artificial Sequence: Synthetic polypeptide
DETEIRTTNPIATECWGATTWANAEDWAEPKCPYL

SEQ ID NO: 206790 - protein, 35 aa, Artificial Sequence
  Description of Artificial Sequence: Synthetic polypeptide
DETEIRTTNPIATECWGATTWANAEDWAEPKCPYI

SEQ ID NO: 206791 - protein, 36 aa, Artificial Sequence
  Description of Artificial Sequence: Synthetic polypeptide
DETEIRTTNPIATECWGATTWANAEDWAEPKGCPYV

SEQ ID NO: 206792 - protein, 38 aa, Artificial Sequence
  Description of Artificial Sequence: Synthetic polypeptide
DDACISTTNPVATEQYGCVCSNWGEDHNAENFNSDTQA

SEQ ID NO: 206793 - protein, 38 aa, Artificial Sequence
  Description of Artificial Sequence: Synthetic polypeptide
AEAEISTTNPVATEQYGCVCGNWGEDHNAENFNSDTQA

SEQ ID NO: 206794 - protein, 39 aa, Artificial Sequence
  Description of Artificial Sequence: Synthetic polypeptide
DEEEISTTNPVATEQFGQCVCSNWMYDDNIENFSSDTQS

SEQ ID NO: 206795 - protein, 38 aa, Artificial Sequence
  Description of Artificial Sequence: Synthetic polypeptide
TEEEISTTNPVAYECYGTVQACTGYEGQQNKTCGGTIE

SEQ ID NO: 206796 - protein, 37 aa, Artificial Sequence
  Description of Artificial Sequence: Synthetic polypeptide
CEEAISCTNPVAYEQYGCVCSMWGEHNAENFNSDTQP

SEQ ID NO: 206797 - protein, 38 aa, Artificial Sequence
  Description of Artificial Sequence: Synthetic polypeptide
TEEEISTTNPVAYECYGTVQACTGYEGQQNTTFGGHIE

SEQ ID NO: 206798 - protein, 40 aa, Artificial Sequence
  Description of Artificial Sequence: Synthetic polypeptide
DEEEIRCTNPVATEQWGICQVCSNWGEDHNAENFGSDTFS

SEQ ID NO: 206799 - protein, 38 aa, Artificial Sequence
  Description of Artificial Sequence: Synthetic polypeptide
TEEEISTTNPVAYECYGTVQACTGYEGQQNYTFGLQIE

SEQ ID NO: 206800 - protein, 38 aa, Artificial Sequence
  Description of Artificial Sequence: Synthetic polypeptide
TEEEISTTNPVAYECYGTVQACTGYMGQQAKTFGGQIE

SEQ ID NO: 206801 - protein, 38 aa, Artificial Sequence
  Description of Artificial Sequence: Synthetic polypeptide
TEEEISTTNPVAYECYGTVQACTLYEGQQNKTFGGQIG

SEQ ID NO: 206802 - protein, 38 aa, Artificial Sequence
  Description of Artificial Sequence: Synthetic polypeptide
TEEEISTTNPVAYECYGTVQNCTGYEGTQNKTFGGQIE

SEQ ID NO: 206803 - protein, 38 aa, Artificial Sequence
  Description of Artificial Sequence: Synthetic polypeptide
TEEEISTTNPVAYECYGVVQACTGYEGQQNKTFTGQIE

SEQ ID NO: 206804 - protein, 38 aa, Artificial Sequence
  Description of Artificial Sequence: Synthetic polypeptide
TEEEISTTNPVAYEEYGTVQACTGYEGQQNKTFGGQIT

SEQ ID NO: 206805 - protein, 38 aa, Artificial Sequence
  Description of Artificial Sequence: Synthetic polypeptide
TEEEISTTNPVAYENYGDVQACTGYEGQQNKTFGGQIE

SEQ ID NO: 206806 - protein, 37 aa, Artificial Sequence
  Description of Artificial Sequence: Synthetic polypeptide
TEEEISTTNPVAYENYGTVQACEGYEGQQNAFGGQIE

SEQ ID NO: 206807 - protein, 38 aa, Artificial Sequence
  Description of Artificial Sequence: Synthetic polypeptide
DDNEISTTNPVATEYYGQCVCSNWGEHNAENFNSQTQS

SEQ ID NO: 206808 - protein, 38 aa, Artificial Sequence
  Description of Artificial Sequence: Synthetic polypeptide
TEEEISTTNPVAYENYGTVQACTGYEGQQNKYFGGQEE

SEQ ID NO: 206809 - protein, 39 aa, Artificial Sequence
  Description of Artificial Sequence: Synthetic polypeptide
DEECISTTNPVATEQYGQCVCSNWGEDHDAESFNSDTQS

SEQ ID NO: 206810 - protein, 39 aa, Artificial Sequence
  Description of Artificial Sequence: Synthetic polypeptide
QEVEIATTNPVATEQWGGCACTAIMNGLEPPDAQAGGKY

SEQ ID NO: 206811 - protein, 38 aa, Artificial Sequence
  Description of Artificial Sequence: Synthetic polypeptide
QEVEIATTNPVATEQWGGCTVAINHHAEETNDNQDEAM

SEQ ID NO: 206812 - protein, 38 aa, Artificial Sequence
  Description of Artificial Sequence: Synthetic polypeptide
DEEEIACTNPVATEQWGGCCAAQGNPLTNTAAPGEGPH

SEQ ID NO: 206813 - protein, 40 aa, Artificial Sequence
  Description of Artificial Sequence: Synthetic polypeptide
DENEIRTTNPVASEQYGQASCMCVAGVDLLQEFVVQEDIN

SEQ ID NO: 206814 - protein, 39 aa, Artificial Sequence
  Description of Artificial Sequence: Synthetic polypeptide
DEDEIRTTNPVAYEQWGVACYTGDQLHNDQNTQGQDDDF

SEQ ID NO: 206815 - protein, 39 aa, Artificial Sequence
  Description of Artificial Sequence: Synthetic polypeptide
TEEEISTTNPVAYEQYGQCVCSNWGEDHNAENFNSDNQG

SEQ ID NO: 206816 - protein, 38 aa, Artificial Sequence
  Description of Artificial Sequence: Synthetic polypeptide
TEEEISTTNPVAYESYGTVQACTGYEGQQNKTFQGQIE

SEQ ID NO: 206817 - protein, 38 aa, Artificial Sequence
  Description of Artificial Sequence: Synthetic polypeptide
QEVEIGTTNPAATEQYGVVVVAGNNDGNQEGGEEEQDQ

SEQ ID NO: 206818 - protein, 38 aa, Artificial Sequence
  Description of Artificial Sequence: Synthetic polypeptide
TEEEISTTNPVAYECYGIVQACTGYEGQQNKTFGVQIE

SEQ ID NO: 206819 - protein, 37 aa, Artificial Sequence
  Description of Artificial Sequence: Synthetic polypeptide
QEVEIGTTNPVATEAYGAVVSALDGGDEEEEGGEFDI

SEQ ID NO: 206820 - protein, 38 aa, Artificial Sequence
  Description of Artificial Sequence: Synthetic polypeptide
TEEEISTTNPVAYECYGCTVQACTGYEGQQNKFGGQIY

SEQ ID NO: 206821 - protein, 40 aa, Artificial Sequence
  Description of Artificial Sequence: Synthetic polypeptide
DEEEISTTNPVATEQWGICQVCSYSGEDHNAENFGSDTQA

SEQ ID NO: 206822 - protein, 39 aa, Artificial Sequence
  Description of Artificial Sequence: Synthetic polypeptide
MESEIRTTNPVATEQYGNSYPRETSWDEMKQDESVQQEE

SEQ ID NO: 206823 - protein, 35 aa, Artificial Sequence
  Description of Artificial Sequence: Synthetic polypeptide
QETEIRTTNPIATECWGATTWANAEDWAEPKGEYI

SEQ ID NO: 206824 - protein, 35 aa, Artificial Sequence
  Description of Artificial Sequence: Synthetic polypeptide
QETEIRTTNPIATECWGATTWANAEDWAEPKGPEI

SEQ ID NO: 206825 - protein, 35 aa, Artificial Sequence
  Description of Artificial Sequence: Synthetic polypeptide
QETEIRTTNPIATECWGATTWANAEDWAEPKGPYI

SEQ ID NO: 206826 - protein, 35 aa, Artificial Sequence
  Description of Artificial Sequence: Synthetic polypeptide
QETEIRTTNPIATECWGATTWANAETWAEPKGPYI

SEQ ID NO: 206827 - protein, 35 aa, Artificial Sequence
  Description of Artificial Sequence: Synthetic polypeptide
QETEIRTTNPIATECWGATTWANMEDWAEPKGPYI

SEQ ID NO: 206828 - protein, 39 aa, Artificial Sequence
  Description of Artificial Sequence: Synthetic polypeptide
DDAEISTTNPVATEGYGQCVCSNWEEDHNAENFGSDNQS

SEQ ID NO: 206829 - protein, 42 aa, Artificial Sequence
  Description of Artificial Sequence: Synthetic polypeptide
DIEEEVRTAQQNGQVATRRECAYWGSHILSKRGQLQRGKNRP

SEQ ID NO: 206830 - protein, 39 aa, Artificial Sequence
  Description of Artificial Sequence: Synthetic polypeptide
DEECISTTNPVATEQYGQCVCSNWGEDHNAENFISETQS

SEQ ID NO: 206831 - protein, 39 aa, Artificial Sequence
  Description of Artificial Sequence: Synthetic polypeptide
DDEEIGTTNPVAYEQYGQCVCSNWGEDHNAENFNSDTQA

SEQ ID NO: 206832 - protein, 39 aa, Artificial Sequence
  Description of Artificial Sequence: Synthetic polypeptide
DEECISTTNPVATEQYGQCVCSNWGEDHNAENFISDTQP

SEQ ID NO: 206833 - protein, 39 aa, Artificial Sequence
  Description of Artificial Sequence: Synthetic polypeptide
DEECISTTNPVATEQYGQCVCSNWGEDHNAENFISDTQA

SEQ ID NO: 206834 - protein, 37 aa, Artificial Sequence
  Description of Artificial Sequence: Synthetic polypeptide
TEEEISSTNPVAYECYGTVQACTGYEGQQNKSGGQIE

SEQ ID NO: 206835 - protein, 39 aa, Artificial Sequence
  Description of Artificial Sequence: Synthetic polypeptide
TEQEAECEIATTNPVAYERWGCVYSREGDLQNRAGGTHI

SEQ ID NO: 206836 - protein, 39 aa, Artificial Sequence
  Description of Artificial Sequence: Synthetic polypeptide
DEEEISTTNPVATEQWGQCVCGNWGEDHNIENFNSDTQA

SEQ ID NO: 206837 - protein, 38 aa, Artificial Sequence
  Description of Artificial Sequence: Synthetic polypeptide
DMAEIRTTNPVATEMYGWVCAHSEMDVAEMQDDQEEKN

SEQ ID NO: 206838 - protein, 38 aa, Artificial Sequence
  Description of Artificial Sequence: Synthetic polypeptide
DETEIACTNPVATEQYGSCAAAGGNHDPNAAAEEMNNE

SEQ ID NO: 206839 - protein, 39 aa, Artificial Sequence
  Description of Artificial Sequence: Synthetic polypeptide
DEECISTTNPVATEQYGQCVCSNWGEDHNAENFISDFQS

SEQ ID NO: 206840 - protein, 38 aa, Artificial Sequence
  Description of Artificial Sequence: Synthetic polypeptide
DDNEISTTNPVATEGYGQCVCSNWGEHNAEHFNSDNQA

SEQ ID NO: 206841 - protein, 36 aa, Artificial Sequence
  Description of Artificial Sequence: Synthetic polypeptide
DEMAIGTTNPVATEQYGCLCTATDGSPVEFYTDHKQ

SEQ ID NO: 206842 - protein, 39 aa, Artificial Sequence
  Description of Artificial Sequence: Synthetic polypeptide
DEAEIRTTNPVATEQYGQTIPWPPPLEENQVHSQIEDMQ

SEQ ID NO: 206843 - protein, 38 aa, Artificial Sequence
  Description of Artificial Sequence: Synthetic polypeptide
DEEEIATTNPVAYEPWGHSACAAANGDPAYQGGGDQHQ

SEQ ID NO: 206844 - protein, 38 aa, Artificial Sequence
  Description of Artificial Sequence: Synthetic polypeptide
DEDEIRTTNPVAYEQWGVACYTGDELHMDMNGQGQDDD

SEQ ID NO: 206845 - protein, 39 aa, Artificial Sequence
  Description of Artificial Sequence: Synthetic polypeptide
DEAAIGTTNPVAYEQYGQCVCSNWEEDHNTENFNSDNQA

SEQ ID NO: 206846 - protein, 34 aa, Artificial Sequence
  Description of Artificial Sequence: Synthetic polypeptide
DESEIRSTNPISTECWGATTWANNEDIASPKGPI

SEQ ID NO: 206847 - protein, 38 aa, Artificial Sequence
  Description of Artificial Sequence: Synthetic polypeptide
QEVEIGTTNPVATEIYGTVVVATDGGDEEEDEGGNNDI

SEQ ID NO: 206848 - protein, 38 aa, Artificial Sequence
  Description of Artificial Sequence: Synthetic polypeptide
QEVEIGTTNPVATEIYGTVVVTTDGGDEEEEEGGNNDE

SEQ ID NO: 206849 - protein, 38 aa, Artificial Sequence
  Description of Artificial Sequence: Synthetic polypeptide
DEEEIATTNPVAYEEYSGCTIPNPNVGPQELSINEQTS

SEQ ID NO: 206850 - protein, 40 aa, Artificial Sequence
  Description of Artificial Sequence: Synthetic polypeptide
DEEEISTTNPVAYEQYGQCQVCSNWGEDHNIESFNSENQS

SEQ ID NO: 206851 - protein, 38 aa, Artificial Sequence
  Description of Artificial Sequence: Synthetic polypeptide
DEACISTTNPVATEQYGCVCGNWGEDHNAENFNSDNQG

SEQ ID NO: 206852 - protein, 40 aa, Artificial Sequence
  Description of Artificial Sequence: Synthetic polypeptide
DEEEISTTNPVAYEQYGQCQVCSNWGEDPNAENFNSETQA

SEQ ID NO: 206853 - protein, 39 aa, Artificial Sequence
  Description of Artificial Sequence: Synthetic polypeptide
DEEEISTTNPVAYEQYGQCTCSMWEEDDNAEYFGSDTQA

SEQ ID NO: 206854 - protein, 38 aa, Artificial Sequence
  Description of Artificial Sequence: Synthetic polypeptide
DEEEISTTNPVAYEQYGQCTCSNWGEHNAENFISDTQS

SEQ ID NO: 206855 - protein, 39 aa, Artificial Sequence
  Description of Artificial Sequence: Synthetic polypeptide
DEEEISTTNPVATEGYGQCVCSNWGEDHNIENFISETQA

SEQ ID NO: 206856 - protein, 39 aa, Artificial Sequence
  Description of Artificial Sequence: Synthetic polypeptide
DEEEISTTNPVATEGYGQCVCSNWGEDHNEENFISDTQS

SEQ ID NO: 206857 - protein, 39 aa, Artificial Sequence
  Description of Artificial Sequence: Synthetic polypeptide
DEEEISTTNPVAYEQYGQCVCGMWGEDDNAENFNSDTQD

SEQ ID NO: 206858 - protein, 39 aa, Artificial Sequence
  Description of Artificial Sequence: Synthetic polypeptide
DEEEISTTNPVAYEQYGQCVCGNWGEDHNAENFISDNQS

SEQ ID NO: 206859 - protein, 39 aa, Artificial Sequence
  Description of Artificial Sequence: Synthetic polypeptide
DEEEISTTNPVAYEQYGQCVCGNWGEDHNAENFNSDTQA

SEQ ID NO: 206860 - protein, 39 aa, Artificial Sequence
  Description of Artificial Sequence: Synthetic polypeptide
DEEEISTTNPVAYEQYGQCVCGNWGEDHNAENFNSETQS

SEQ ID NO: 206861 - protein, 39 aa, Artificial Sequence
  Description of Artificial Sequence: Synthetic polypeptide
DEEEISTTNPVAYEQYGQCVCGNWGEDHNAENFSSDNQS

SEQ ID NO: 206862 - protein, 39 aa, Artificial Sequence
  Description of Artificial Sequence: Synthetic polypeptide
DEECISTTNPVATEQYGQCVCSNSGEDHNAENFISDTQS

SEQ ID NO: 206863 - protein, 39 aa, Artificial Sequence
  Description of Artificial Sequence: Synthetic polypeptide
DEEEISTTNPVAYEQYGQCVCQMWGEDHNAENFISDNQS

SEQ ID NO: 206864 - protein, 39 aa, Artificial Sequence
  Description of Artificial Sequence: Synthetic polypeptide
DEEEISTTNPVATEGYGQCVCSNWGEDHNAENFISDTQS

SEQ ID NO: 206865 - protein, 39 aa, Artificial Sequence
  Description of Artificial Sequence: Synthetic polypeptide
DEEEISTTNPVAYEQYGQCVCQNWGEDHNAENFGSETQA

SEQ ID NO: 206866 - protein, 39 aa, Artificial Sequence
  Description of Artificial Sequence: Synthetic polypeptide
DEEEISTTNPVAYEQYGQCVCQNWGEDHNAENFISDNQA

SEQ ID NO: 206867 - protein, 39 aa, Artificial Sequence
  Description of Artificial Sequence: Synthetic polypeptide
DEEEISTTNPVAYEQYGQCVCQNWGEDHNAENFNSDPQS

SEQ ID NO: 206868 - protein, 39 aa, Artificial Sequence
  Description of Artificial Sequence: Synthetic polypeptide
DEEEISTTNPVAYEQYGQCVCQNWGEDHNAENFPSDTQS

SEQ ID NO: 206869 - protein, 38 aa, Artificial Sequence
  Description of Artificial Sequence: Synthetic polypeptide
AEEEIATTNPVATEQYGQCYCGWGEDDNAEHFNSETQA

SEQ ID NO: 206870 - protein, 39 aa, Artificial Sequence
  Description of Artificial Sequence: Synthetic polypeptide
DEECISTTNPVATEQYGQCVCSMWGEDHNAENFISDTQS

SEQ ID NO: 206871 - protein, 39 aa, Artificial Sequence
  Description of Artificial Sequence: Synthetic polypeptide
DEECISTTNPVATEQYGQCVCSDWGEDHNAEHFSSDTQA

SEQ ID NO: 206872 - protein, 40 aa, Artificial Sequence
  Description of Artificial Sequence: Synthetic polypeptide
DEEEISTTNPVAYEQYGQCQVCSNWGEDHNAESFNSDTQA

SEQ ID NO: 206873 - protein, 38 aa, Artificial Sequence
  Description of Artificial Sequence: Synthetic polypeptide
QEVEIGTTNPVATEIYGTVVVATDGGDEEEEEGGNNVM

SEQ ID NO: 206874 - protein, 40 aa, Artificial Sequence
  Description of Artificial Sequence: Synthetic polypeptide
DEEEISTTNPVAYEQYGQCQVCSNWGEDHNAENFNSDTQA

SEQ ID NO: 206875 - protein, 38 aa, Artificial Sequence
  Description of Artificial Sequence: Synthetic polypeptide
DEACISTTNPVATEQYGCVCGNWGEDHNAENFNSETQA

SEQ ID NO: 206876 - protein, 38 aa, Artificial Sequence
  Description of Artificial Sequence: Synthetic polypeptide
CEEEISCTNPVATEEYGQCVCSNWGEHNAENFISDNQS

SEQ ID NO: 206877 - protein, 35 aa, Artificial Sequence
  Description of Artificial Sequence: Synthetic polypeptide
VESEIRTTNPVSTEPWGCIAPEDGQQQQQQRTTEG

SEQ ID NO: 206878 - protein, 38 aa, Artificial Sequence
  Description of Artificial Sequence: Synthetic polypeptide
QEEEIVTTNPVATEFYGVVMAGPIEGEGGQGEMNEIDM

SEQ ID NO: 206879 - protein, 35 aa, Artificial Sequence
  Description of Artificial Sequence: Synthetic polypeptide
QENEIATTNPVATASWGCVAGKGGEEMNAMLDNLH

SEQ ID NO: 206880 - protein, 39 aa, Artificial Sequence
  Description of Artificial Sequence: Synthetic polypeptide
AEEEISTTNPVATEQYGQCVCSNWEEDHNTEGFISDTQA

SEQ ID NO: 206881 - protein, 39 aa, Artificial Sequence
  Description of Artificial Sequence: Synthetic polypeptide
CEEEISCTNPVATEQYGQCQVCSMWGEHNAENFNSDTQP

SEQ ID NO: 206882 - protein, 38 aa, Artificial Sequence
  Description of Artificial Sequence: Synthetic polypeptide
DEEEIACTNPVATEQWGHVCAAGGAGGENTADVNDSMT

SEQ ID NO: 206883 - protein, 39 aa, Artificial Sequence
  Description of Artificial Sequence: Synthetic polypeptide
CEEEISCTNPVATEQYGQCVCSNWGEDHNAENFGSETQS

SEQ ID NO: 206884 - protein, 39 aa, Artificial Sequence
  Description of Artificial Sequence: Synthetic polypeptide
CEEEISCTNPVATEQYGQCVCSNWGEDHNAEYFNSDNQD

SEQ ID NO: 206885 - protein, 39 aa, Artificial Sequence
  Description of Artificial Sequence: Synthetic polypeptide
CEEEISCTNPVATEQYGQCVCSNWGEDHNAEYFNSDPQS

SEQ ID NO: 206886 - protein, 39 aa, Artificial Sequence
  Description of Artificial Sequence: Synthetic polypeptide
CEEEISCTNPVATEQYGQCVCSNWGEDHNQENFSSDNQA

SEQ ID NO: 206887 - protein, 36 aa, Artificial Sequence
  Description of Artificial Sequence: Synthetic polypeptide
DEMAIGTTNPVATEQYGCLCTATDGSPVEFETDCEQ

SEQ ID NO: 206888 - protein, 38 aa, Artificial Sequence
  Description of Artificial Sequence: Synthetic polypeptide
CEEEISCTNPVATEYYGCVCSMWGEDHNAENFNSDTQP

SEQ ID NO: 206889 - protein, 37 aa, Artificial Sequence
  Description of Artificial Sequence: Synthetic polypeptide
CEEEISCTNPVAYEQYGCVCPNWGEHNAENFNSDNQA

SEQ ID NO: 206890 - protein, 38 aa, Artificial Sequence
  Description of Artificial Sequence: Synthetic polypeptide
DEEEIATTNPVAYEEYGICTIPNPNVGPQEASINEQTS

SEQ ID NO: 206891 - protein, 39 aa, Artificial Sequence
  Description of Artificial Sequence: Synthetic polypeptide
DEMEISTTNPVATEQYGICVCGNWGEDPNAEFFGSDTQA

SEQ ID NO: 206892 - protein, 40 aa, Artificial Sequence
  Description of Artificial Sequence: Synthetic polypeptide
DEMEISTTNPVATEQYGQCAVCSNWGEDHNAENFNSDTQS

SEQ ID NO: 206893 - protein, 39 aa, Artificial Sequence
  Description of Artificial Sequence: Synthetic polypeptide
DNGEIRCTNPVATEQYGSCVNYATPHATEYEGHSVDQKE

SEQ ID NO: 206894 - protein, 40 aa, Artificial Sequence
  Description of Artificial Sequence: Synthetic polypeptide
DEEEISTTNPVAYEQYGQCAVCSNWGEDHNAEYFNSDTQA

SEQ ID NO: 206895 - protein, 40 aa, Artificial Sequence
  Description of Artificial Sequence: Synthetic polypeptide
DEEEISTTNPVAYEQYGQCAVCSNWMEDHNAENFNSETQS

SEQ ID NO: 206896 - protein, 40 aa, Artificial Sequence
  Description of Artificial Sequence: Synthetic polypeptide
DEMEISTTNPVATEQYGQCIVCSNWGEDHNTENFNSETQA

SEQ ID NO: 206897 - protein, 40 aa, Artificial Sequence
  Description of Artificial Sequence: Synthetic polypeptide
DEEEISTTNPVAYEQYGQCQVCSNSGEDHNAENFNSETQA

SEQ ID NO: 206898 - protein, 39 aa, Artificial Sequence
  Description of Artificial Sequence: Synthetic polypeptide
DEEEISTTNPVAYEQYGQCQVCSNSGEHNEENFPSDTQS

SEQ ID NO: 206899 - protein, 40 aa, Artificial Sequence
  Description of Artificial Sequence: Synthetic polypeptide
DEEEISTTNPVAYEQYGQCQVCSNWGEDDNQENFNSDTQS

SEQ ID NO: 206900 - protein, 39 aa, Artificial Sequence
  Description of Artificial Sequence: Synthetic polypeptide
DEECISTTNPVATEQYGQCVCQNWGEDHNAENFNSETQM

SEQ ID NO: 206901 - protein, 39 aa, Artificial Sequence
  Description of Artificial Sequence: Synthetic polypeptide
CEEEIRTTNPVAYEQYGQCVCSNWGEDHNEENFISDTQA

SEQ ID NO: 206902 - protein, 40 aa, Artificial Sequence
  Description of Artificial Sequence: Synthetic polypeptide
CEEEIRTTNPVAYEQYGQCQVCSNWGEDHNAENFNSDTQD

SEQ ID NO: 206903 - protein, 39 aa, Artificial Sequence
  Description of Artificial Sequence: Synthetic polypeptide
DEEEISTTNPVAYEGYGQCVCSNWGEDHNAEFFISDNQS

SEQ ID NO: 206904 - protein, 38 aa, Artificial Sequence
  Description of Artificial Sequence: Synthetic polypeptide
DESSVIACTNPVATEQWGCVAGTANGFPDPAGSEMNKE

SEQ ID NO: 206905 - protein, 38 aa, Artificial Sequence
  Description of Artificial Sequence: Synthetic polypeptide
DEEAISTTNPVATEAYGQCVCGNWGEHNAENFNSDNQA

SEQ ID NO: 206906 - protein, 39 aa, Artificial Sequence
  Description of Artificial Sequence: Synthetic polypeptide
DEEEISTTNPVAYEGYGQCVCSNWGEDHNAEGFNSDTQS

SEQ ID NO: 206907 - protein, 35 aa, Artificial Sequence
  Description of Artificial Sequence: Synthetic polypeptide
MESEIRTTNPCSTEPWGCIAPEDQQQQQQQGGTNS

SEQ ID NO: 206908 - protein, 39 aa, Artificial Sequence
  Description of Artificial Sequence: Synthetic polypeptide
DEEEISTTNPVAYEGYGQCVCSNWGEDHNAEHFNSDNQA

SEQ ID NO: 206909 - protein, 39 aa, Artificial Sequence
  Description of Artificial Sequence: Synthetic polypeptide
DEEEISTTNPVAYEGYGQCVCSNWGEDHNAEHFNSDTQA

SEQ ID NO: 206910 - protein, 39 aa, Artificial Sequence
  Description of Artificial Sequence: Synthetic polypeptide
DEEEISTTNPVAYEGYGQCVCSNWGEDHNAENFISDNQP

SEQ ID NO: 206911 - protein, 38 aa, Artificial Sequence
  Description of Artificial Sequence: Synthetic polypeptide
DEACISTTNPVATEQYGQCVCENWGEPNAEYFNSDNQA

SEQ ID NO: 206912 - protein, 39 aa, Artificial Sequence
  Description of Artificial Sequence: Synthetic polypeptide
DEEEISTTNPVAYEGYGQCVCSNWGEDHNAENFISDNQS

SEQ ID NO: 206913 - protein, 39 aa, Artificial Sequence
  Description of Artificial Sequence: Synthetic polypeptide
DEEEISTTNPVAYEGYGQCVCSNWGEDHNAENFISENQP

SEQ ID NO: 206914 - protein, 39 aa, Artificial Sequence
  Description of Artificial Sequence: Synthetic polypeptide
DEECISTTNPVATEGYGQCVCSNWGELHNEENFNSDTQS

SEQ ID NO: 206915 - protein, 39 aa, Artificial Sequence
  Description of Artificial Sequence: Synthetic polypeptide
DEEEISTTNPVAYEGYGQCVCSNWGEDHNAENFNSDNAA

SEQ ID NO: 206916 - protein, 39 aa, Artificial Sequence
  Description of Artificial Sequence: Synthetic polypeptide
DEEEISTTNPVAYEGYGQCVCSNWGEDHNAENFNSDNQS

SEQ ID NO: 206917 - protein, 39 aa, Artificial Sequence
  Description of Artificial Sequence: Synthetic polypeptide
DEEEISTTNPVAYEGYGQCVCSNWGEDHNAENFNSDTQA

SEQ ID NO: 206918 - protein, 38 aa, Artificial Sequence
  Description of Artificial Sequence: Synthetic polypeptide
DEMEISTTNPVATEGYGICVCSWGEDDNAENFISDTQA

SEQ ID NO: 206919 - protein, 39 aa, Artificial Sequence
  Description of Artificial Sequence: Synthetic polypeptide
DEEEISTTNPVAYEGYGQCVCSNWGEDHNAENFNSDTQP

SEQ ID NO: 206920 - protein, 39 aa, Artificial Sequence
  Description of Artificial Sequence: Synthetic polypeptide
DEECISTTNPVATEGYGQCVCSTWGEDHNAEYFMSDTQS

SEQ ID NO: 206921 - protein, 39 aa, Artificial Sequence
  Description of Artificial Sequence: Synthetic polypeptide
AEEEISTTNPVATEQYGQCVCSNWGEDHNAEFFISDTQA

SEQ ID NO: 206922 - protein, 39 aa, Artificial Sequence
  Description of Artificial Sequence: Synthetic polypeptide
DEEEISTTNPVAYEGYGQCVCSNWGEDHNAENFNSDTQS

SEQ ID NO: 206923 - protein, 35 aa, Artificial Sequence
  Description of Artificial Sequence: Synthetic polypeptide
DESEIRSTNPIATECWGATTWANAEDIAEPKGPYI

SEQ ID NO: 206924 - protein, 39 aa, Artificial Sequence
  Description of Artificial Sequence: Synthetic polypeptide
DEEAIRTTNPVAYEGYGQCVCSNWGEDHNAENFNSDNQP

SEQ ID NO: 206925 - protein, 39 aa, Artificial Sequence
  Description of Artificial Sequence: Synthetic polypeptide
DEEEISTTNPVAYEGYGQCVCSNWGEDHNAENFNSETQP

SEQ ID NO: 206926 - protein, 39 aa, Artificial Sequence
  Description of Artificial Sequence: Synthetic polypeptide
DEEEISTTNPVAYEGYGQCVCSNWGEDDNIENFNSETQA

SEQ ID NO: 206927 - protein, 39 aa, Artificial Sequence
  Description of Artificial Sequence: Synthetic polypeptide
DEEEISTTNPVAYEGYGQCVCSNWGEDHNAENFNSETQS

SEQ ID NO: 206928 - protein, 38 aa, Artificial Sequence
  Description of Artificial Sequence: Synthetic polypeptide
DEDEIATTNPVATEQWGCNCNAGTGDHPGNNHPDDSNN

SEQ ID NO: 206929 - protein, 38 aa, Artificial Sequence
  Description of Artificial Sequence: Synthetic polypeptide
DEACISTTNPVATEQYGQCVCGMWEEHNAENFNSDTQA

SEQ ID NO: 206930 - protein, 39 aa, Artificial Sequence
  Description of Artificial Sequence: Synthetic polypeptide
DEEEISTTNPVAYEGYGQCVCGNWGEDHNAEGFNSDNQS

SEQ ID NO: 206931 - protein, 34 aa, Artificial Sequence
  Description of Artificial Sequence: Synthetic polypeptide
TESEIAATNPVGTEAWGVCAPTDRDQHQGQHQVD

SEQ ID NO: 206932 - protein, 39 aa, Artificial Sequence
  Description of Artificial Sequence: Synthetic polypeptide
DEACISTTNPVATEQYGQCVCSMWEEDHNAENFNSDTQS

SEQ ID NO: 206933 - protein, 39 aa, Artificial Sequence
  Description of Artificial Sequence: Synthetic polypeptide
DEEEISTTNPVAYEGYGQCVCPTSGEDHNAENFNSDTQA

SEQ ID NO: 206934 - protein, 38 aa, Artificial Sequence
  Description of Artificial Sequence: Synthetic polypeptide
DEEEISTTNPVAYEGYGQCVCQNWGEHNAENFNSDNQS

SEQ ID NO: 206935 - protein, 35 aa, Artificial Sequence
  Description of Artificial Sequence: Synthetic polypeptide
DEGEIRTTNPIATECWGATTWANAEDWAEPKVPYI

SEQ ID NO: 206936 - protein, 39 aa, Artificial Sequence
  Description of Artificial Sequence: Synthetic polypeptide
DEEEISTTNPVAYEGYGQCVCSMWGEDHNAENFISDNQS

SEQ ID NO: 206937 - protein, 36 aa, Artificial Sequence
  Description of Artificial Sequence: Synthetic polypeptide
DESEIRTTNPIATECWGATTWANAEDWAEPKGEPYI

SEQ ID NO: 206938 - protein, 39 aa, Artificial Sequence
  Description of Artificial Sequence: Synthetic polypeptide
DEEEISTTNPVAYEGYGQCVCSNSGEDHNAEYFNSDTQS

SEQ ID NO: 206939 - protein, 36 aa, Artificial Sequence
  Description of Artificial Sequence: Synthetic polypeptide
QEEEIATTNPVAYEWYGEHIPWCEHEFSHSHAEGEA

SEQ ID NO: 206940 - protein, 39 aa, Artificial Sequence
  Description of Artificial Sequence: Synthetic polypeptide
DEEEISTTNPVAYEGYGQCVCSNWEEDHNAEHFNSDNQG

SEQ ID NO: 206941 - protein, 39 aa, Artificial Sequence
  Description of Artificial Sequence: Synthetic polypeptide
DEACISTTNPVATEQYGQCVCSDWGEDHNAENFNSENQA

SEQ ID NO: 206942 - protein, 39 aa, Artificial Sequence
  Description of Artificial Sequence: Synthetic polypeptide
DEEEISTTNPVAYEGYGQCVCSNWEEDHNAEYFNSDTQS

SEQ ID NO: 206943 - protein, 38 aa, Artificial Sequence
  Description of Artificial Sequence: Synthetic polypeptide
CEMCISTTNPVATEQYGCVCSNWGEDHNAENFNSETQS

SEQ ID NO: 206944 - protein, 38 aa, Artificial Sequence
  Description of Artificial Sequence: Synthetic polypeptide
AEEEIATTNPVAYEQYGQCSCPNWGEDNAEHFISENQA

SEQ ID NO: 206945 - protein, 38 aa, Artificial Sequence
  Description of Artificial Sequence: Synthetic polypeptide
DEACISTTNPVATEQYGQCVCGNWGEHNAENFNSDTQS

SEQ ID NO: 206946 - protein, 39 aa, Artificial Sequence
  Description of Artificial Sequence: Synthetic polypeptide
DEEEISTTNPVAYEGYGQCVCSNWGEDDNAEFFNSDNQS

SEQ ID NO: 206947 - protein, 39 aa, Artificial Sequence
  Description of Artificial Sequence: Synthetic polypeptide
DEEEISTTNPVAYEGYGQCVCSNWGEDDNAENFNSDFQS

SEQ ID NO: 206948 - protein, 39 aa, Artificial Sequence
  Description of Artificial Sequence: Synthetic polypeptide
DEEEISTTNPVAYEGYGQCVCSNWGEDDNAENFNSDNQS

SEQ ID NO: 206949 - protein, 39 aa, Artificial Sequence
  Description of Artificial Sequence: Synthetic polypeptide
DEEEISTTNPVAYEGYGQCVCSNWGEDDNIENFNSDNQA

SEQ ID NO: 206950 - protein, 38 aa, Artificial Sequence
  Description of Artificial Sequence: Synthetic polypeptide
DEACISTTNPVATEQYGQCVCGNWGEHNAENFNSDNQS

SEQ ID NO: 206951 - protein, 39 aa, Artificial Sequence
  Description of Artificial Sequence: Synthetic polypeptide
DEMEISTTNPVATEQYGQCVCSNWGEDPNEEFFISDTQS

SEQ ID NO: 206952 - protein, 39 aa, Artificial Sequence
  Description of Artificial Sequence: Synthetic polypeptide
DEACISTTNPVATEQYGQCVCGNSGEDDNAENFNSETQA

SEQ ID NO: 206953 - protein, 36 aa, Artificial Sequence
  Description of Artificial Sequence: Synthetic polypeptide
DENENATTNPCAYECWGCVAGTPNGNQQLEGDHGTQ

SEQ ID NO: 206954 - protein, 35 aa, Artificial Sequence
  Description of Artificial Sequence: Synthetic polypeptide
QAEEIATTNPVATASWGCNVNAGAGLNTAGGDIDF

SEQ ID NO: 206955 - protein, 39 aa, Artificial Sequence
  Description of Artificial Sequence: Synthetic polypeptide
DEEEISTTNPVAYEGYGQCVCSNWGEDHNAESFNSDNQA

SEQ ID NO: 206956 - protein, 39 aa, Artificial Sequence
  Description of Artificial Sequence: Synthetic polypeptide
DEEEISTTNPVAYEGYGQCVCSNWGEDHNAEYFNSETQA

SEQ ID NO: 206957 - protein, 37 aa, Artificial Sequence
  Description of Artificial Sequence: Synthetic polypeptide
DDNEIRTTNPVAYEQWGCVCSNSGEENAEYSISDTAS

SEQ ID NO: 206958 - protein, 39 aa, Artificial Sequence
  Description of Artificial Sequence: Synthetic polypeptide
DEMEISTTNPVATEGYGQCVCSNWEEDHNQENFNSDTQS

SEQ ID NO: 206959 - protein, 38 aa, Artificial Sequence
  Description of Artificial Sequence: Synthetic polypeptide
MESEIRTTNPVATEQWGNCKAFYVMDQEPNDNDHNQDQ

SEQ ID NO: 206960 - protein, 39 aa, Artificial Sequence
  Description of Artificial Sequence: Synthetic polypeptide
DEMEISTTNPVATEGYGQCVCSNWGEDHNAENFNSDFQS

SEQ ID NO: 206961 - protein, 39 aa, Artificial Sequence
  Description of Artificial Sequence: Synthetic polypeptide
DSEEIRATNPVATEQWGGCCNAANNGVLDVGMAMDENTP

SEQ ID NO: 206962 - protein, 39 aa, Artificial Sequence
  Description of Artificial Sequence: Synthetic polypeptide
DEMEISTTNPVATEGYGQCVCSNWGEDHNAENFNSENQS

SEQ ID NO: 206963 - protein, 39 aa, Artificial Sequence
  Description of Artificial Sequence: Synthetic polypeptide
DEMEISTTNPVATEGYGQCVTSTWGADHNAENFISDPQA

SEQ ID NO: 206964 - protein, 38 aa, Artificial Sequence
  Description of Artificial Sequence: Synthetic polypeptide
MESEIRTTNPVATEQWGNCVHAFYVQDQEPDTDHNQDQ

SEQ ID NO: 206965 - protein, 34 aa, Artificial Sequence
  Description of Artificial Sequence: Synthetic polypeptide
DESEIRSTNPISTECWGATTWANAEDIAEPKGPI

SEQ ID NO: 206966 - protein, 38 aa, Artificial Sequence
  Description of Artificial Sequence: Synthetic polypeptide
DEMEISTTNPVATEQWGCVCSNSGEDDNAENSSSDTAA

SEQ ID NO: 206967 - protein, 38 aa, Artificial Sequence
  Description of Artificial Sequence: Synthetic polypeptide
MESEIRTTNPVATEQWGNCVKCAFYVMDQEPDDHNQDQ

SEQ ID NO: 206968 - protein, 39 aa, Artificial Sequence
  Description of Artificial Sequence: Synthetic polypeptide
DEECISTTNPVATEQYGQCVCSNWGEDHNIEYFMSDTQS

SEQ ID NO: 206969 - protein, 34 aa, Artificial Sequence
  Description of Artificial Sequence: Synthetic polypeptide
DESEIRSTNPISTECWGATTWANNEDIAEPKGPI

SEQ ID NO: 206970 - protein, 39 aa, Artificial Sequence
  Description of Artificial Sequence: Synthetic polypeptide
DEECISTTNPVATEQYGQCVCSNWGEDHNIENFISQTQS

SEQ ID NO: 206971 - protein, 38 aa, Artificial Sequence
  Description of Artificial Sequence: Synthetic polypeptide
DDAEISTTNPVATEGYGCVCSNWEEDHNAENFNSDTQG

SEQ ID NO: 206972 - protein, 38 aa, Artificial Sequence
  Description of Artificial Sequence: Synthetic polypeptide
CETEIACTNPVATEQYGSACNPTPDGHPLGAMEGFDQQ

SEQ ID NO: 206973 - protein, 38 aa, Artificial Sequence
  Description of Artificial Sequence: Synthetic polypeptide
DEMEISTTNPVATEQWGQCVCQNWGAHNIENFMSQTQS

SEQ ID NO: 206974 - protein, 36 aa, Artificial Sequence
  Description of Artificial Sequence: Synthetic polypeptide
QEEEIATTNPVAYYAPQWGHSIAAAGEDDDSGNEEG

SEQ ID NO: 206975 - protein, 38 aa, Artificial Sequence
  Description of Artificial Sequence: Synthetic polypeptide
DDAEISTTNPVATEGYGCVCSNWGEDHNAEYFNSENQS

SEQ ID NO: 206976 - protein, 37 aa, Artificial Sequence
  Description of Artificial Sequence: Synthetic polypeptide
DATEIACTNPVATEQWGHVVANTGNGEYGAEGTGADG

SEQ ID NO: 206977 - protein, 39 aa, Artificial Sequence
  Description of Artificial Sequence: Synthetic polypeptide
CEEEIRTTNPVAYEQWGQCVCSNWGEDHNAENFNSDNQA

SEQ ID NO: 206978 - protein, 38 aa, Artificial Sequence
  Description of Artificial Sequence: Synthetic polypeptide
DATAEIATTNPVAYEQYGSVPAIANNDDQPDSKAIEHH

SEQ ID NO: 206979 - protein, 38 aa, Artificial Sequence
  Description of Artificial Sequence: Synthetic polypeptide
DEEEIATTNPVAYEPWGHSACAAANGQDAMQGGGDQHQ

SEQ ID NO: 206980 - protein, 37 aa, Artificial Sequence
  Description of Artificial Sequence: Synthetic polypeptide
MESEIRTTNPVATEQWGNCKAFYVEDQEPDDDHNQDQ

SEQ ID NO: 206981 - protein, 39 aa, Artificial Sequence
  Description of Artificial Sequence: Synthetic polypeptide
DEEEISTTNPVAYEGYGQCVCSNWGEDHNAEYFNSDNQS

SEQ ID NO: 206982 - protein, 36 aa, Artificial Sequence
  Description of Artificial Sequence: Synthetic polypeptide
MESEIRTTNPVATEQWGNCKAAYVQDDEPDDHPQDQ

SEQ ID NO: 206983 - protein, 35 aa, Artificial Sequence
  Description of Artificial Sequence: Synthetic polypeptide
DEYEIRTTNPIATECWGATTWANAEDWAEPKIPYI

SEQ ID NO: 206984 - protein, 39 aa, Artificial Sequence
  Description of Artificial Sequence: Synthetic polypeptide
DEEEISTTNPVAYEGYGQCVCSNWGEDHNIENFNSDTQG

SEQ ID NO: 206985 - protein, 39 aa, Artificial Sequence
  Description of Artificial Sequence: Synthetic polypeptide
DEEEISTTNPVAYEGYGQCVCSNWGEDHNIEYFNSDTQS

SEQ ID NO: 206986 - protein, 39 aa, Artificial Sequence
  Description of Artificial Sequence: Synthetic polypeptide
DEEEISTTNPVAYEGYGQCVCSNWGEDHNIEYFNSENQS

SEQ ID NO: 206987 - protein, 39 aa, Artificial Sequence
  Description of Artificial Sequence: Synthetic polypeptide
DEEEISTTNPVAYEGYGQCVCSNWGEDHNIEYFNSETQA

SEQ ID NO: 206988 - protein, 38 aa, Artificial Sequence
  Description of Artificial Sequence: Synthetic polypeptide
DENEISTTNPVATEQWGQCVCSNSGEHNAEYSISDTQS

SEQ ID NO: 206989 - protein, 38 aa, Artificial Sequence
  Description of Artificial Sequence: Synthetic polypeptide
DENEISTTNPVATEQWGQCVTSNWGEDNTEYFISDTQS

SEQ ID NO: 206990 - protein, 38 aa, Artificial Sequence
  Description of Artificial Sequence: Synthetic polypeptide
DEMCISTTNPVAYEQYGQCVCSNWGEHNAENFNSDNQS

SEQ ID NO: 206991 - protein, 38 aa, Artificial Sequence
  Description of Artificial Sequence: Synthetic polypeptide
CEEAISTTNPVATEQYGQCVCSNWGEHDIEHFNSDTQS

SEQ ID NO: 206992 - protein, 39 aa, Artificial Sequence
  Description of Artificial Sequence: Synthetic polypeptide
DEEEISTTNPVAYEGYGQCVCSNWGEDHNTEHFNSEFQS

SEQ ID NO: 206993 - protein, 39 aa, Artificial Sequence
  Description of Artificial Sequence: Synthetic polypeptide
CEEAISTTNPVATEQYGQCVCSNWGEDHNAENFNSDTQD

SEQ ID NO: 206994 - protein, 39 aa, Artificial Sequence
  Description of Artificial Sequence: Synthetic polypeptide
DEEEISTTNPVAYEGYGQCVCSNWGEDPNIENFNSDNQN

SEQ ID NO: 206995 - protein, 39 aa, Artificial Sequence
  Description of Artificial Sequence: Synthetic polypeptide
DEEEISTTNPVAYEGYGQCVCSNWGEGHNAENFNSDTQS

SEQ ID NO: 206996 - protein, 36 aa, Artificial Sequence
  Description of Artificial Sequence: Synthetic polypeptide
AEEEIATTNPVAYEGYGCYCPWGEDNQEHFNSETQA

SEQ ID NO: 206997 - protein, 35 aa, Artificial Sequence
  Description of Artificial Sequence: Synthetic polypeptide
DEYEIRTTNPIATECWGATTWAGAEDWAEPKGPYI

SEQ ID NO: 206998 - protein, 36 aa, Artificial Sequence
  Description of Artificial Sequence: Synthetic polypeptide
DEYEIRTTNPIATECWGATTWANAEDWAEPKGPYIK

SEQ ID NO: 206999 - protein, 36 aa, Artificial Sequence
  Description of Artificial Sequence: Synthetic polypeptide
DEYEIRTTNPIATECWGATTWANAEDWAEPKGRPYI

SEQ ID NO: 207000 - protein, 38 aa, Artificial Sequence
  Description of Artificial Sequence: Synthetic polypeptide
MESEIRTTNPVATEIYGMCVCPDTRVPEEAMEGQGVEN

SEQ ID NO: 207001 - protein, 39 aa, Artificial Sequence
  Description of Artificial Sequence: Synthetic polypeptide
DEEEISTTNPVAYEGYGQCVCSNWGELHNAENFNSDTQS

SEQ ID NO: 207002 - protein, 39 aa, Artificial Sequence
  Description of Artificial Sequence: Synthetic polypeptide
DEEEISTTNPVAYEGYGQCVCSNWGYDHNAENFNSDNQA

SEQ ID NO: 207003 - protein, 39 aa, Artificial Sequence
  Description of Artificial Sequence: Synthetic polypeptide
DEEEISTTNPVAYEGYGQCVCSNWGYDHNAENFNSDNQS

SEQ ID NO: 207004 - protein, 39 aa, Artificial Sequence
  Description of Artificial Sequence: Synthetic polypeptide
DEEEISTTNPVAYEGYGQCVCSNWGYDHNAENFNSDTQS

SEQ ID NO: 207005 - protein, 39 aa, Artificial Sequence
  Description of Artificial Sequence: Synthetic polypeptide
DEEEISTTNPVAYEGYGQCVCSNWMEDDNAEYFNSQTQS

SEQ ID NO: 207006 - protein, 39 aa, Artificial Sequence
  Description of Artificial Sequence: Synthetic polypeptide
DEEEISTTNPVAYEGYGQCVCSNWMEDHNTENFNSDTQP

SEQ ID NO: 207007 - protein, 37 aa, Artificial Sequence
  Description of Artificial Sequence: Synthetic polypeptide
MESEIRTTNPVATEQWGNCFAFYVQDQEPTDDHNQDQ

SEQ ID NO: 207008 - protein, 38 aa, Artificial Sequence
  Description of Artificial Sequence: Synthetic polypeptide
DEDEIATTNPVATEQWGCNCTAATGDHPGDNHPDDSNN

SEQ ID NO: 207009 - protein, 37 aa, Artificial Sequence
  Description of Artificial Sequence: Synthetic polypeptide
AEEEIATTNPVATEQYGQCFCPWGEDNQEHFSSETQS

SEQ ID NO: 207010 - protein, 39 aa, Artificial Sequence
  Description of Artificial Sequence: Synthetic polypeptide
DEECISTTNPVATEQYGQCVCQMWGEDHNAENFNSDPQS

SEQ ID NO: 207011 - protein, 38 aa, Artificial Sequence
  Description of Artificial Sequence: Synthetic polypeptide
CEEEISTTNPVATEGYGQCVCQNWGEHNAENFNSDNQA

SEQ ID NO: 207012 - protein, 38 aa, Artificial Sequence
  Description of Artificial Sequence: Synthetic polypeptide
DEACISTTNPVATEGYGQCVCSNWGEHNAENFNSDTQS

SEQ ID NO: 207013 - protein, 39 aa, Artificial Sequence
  Description of Artificial Sequence: Synthetic polypeptide
DEEEISTTNPVATEGWGQCVCSMSGEDHNAENFNSDNQA

SEQ ID NO: 207014 - protein, 39 aa, Artificial Sequence
  Description of Artificial Sequence: Synthetic polypeptide
DDAEISTTNPVATEQYGQCVCSNWGEDHNAENFGSDTQG

SEQ ID NO: 207015 - protein, 39 aa, Artificial Sequence
  Description of Artificial Sequence: Synthetic polypeptide
CEEEISTTNPVATEGYGQCVCSNSGEDDNAENFNSDTQS

SEQ ID NO: 207016 - protein, 38 aa, Artificial Sequence
  Description of Artificial Sequence: Synthetic polypeptide
DEHNEIATTNPVAYERWGEVCSTPNQGNHGEAGGDGDN

SEQ ID NO: 207017 - protein, 39 aa, Artificial Sequence
  Description of Artificial Sequence: Synthetic polypeptide
DEEEIACTNPVATEQWGTHVVANSGALADAGTHQIQESW

SEQ ID NO: 207018 - protein, 39 aa, Artificial Sequence
  Description of Artificial Sequence: Synthetic polypeptide
CEEEISTTNPVATEGYGQCVCSNWGEDHNAEHSNSDTQS

SEQ ID NO: 207019 - protein, 39 aa, Artificial Sequence
  Description of Artificial Sequence: Synthetic polypeptide
DETAEIATTNPVAYEQYGSVPAIANHAEEATGGGMEMEM

SEQ ID NO: 207020 - protein, 39 aa, Artificial Sequence
  Description of Artificial Sequence: Synthetic polypeptide
CEEEISTTNPVATEGYGQCVCSNWGEDHNAENFNSETQS

SEQ ID NO: 207021 - protein, 38 aa, Artificial Sequence
  Description of Artificial Sequence: Synthetic polypeptide
DSDCIRTVNPVAYEQYGCVVPATTGNALAANTAGGLSV

SEQ ID NO: 207022 - protein, 38 aa, Artificial Sequence
  Description of Artificial Sequence: Synthetic polypeptide
DEDEIATTNPVATEQWGCNCAPTGDHPGDNHPDDSLNN

SEQ ID NO: 207023 - protein, 39 aa, Artificial Sequence
  Description of Artificial Sequence: Synthetic polypeptide
DDAEISTTNPVATEQYGQCVCSNWGEDHNAENFGSDTQP

SEQ ID NO: 207024 - protein, 39 aa, Artificial Sequence
  Description of Artificial Sequence: Synthetic polypeptide
CEEEISTTNPVATEGYGQCVCSNWGEDHNQENFNSDPQP

SEQ ID NO: 207025 - protein, 36 aa, Artificial Sequence
  Description of Artificial Sequence: Synthetic polypeptide
DETEIACTNPVATAQWGCVAGPTGEPGDEHNNDQFE

SEQ ID NO: 207026 - protein, 39 aa, Artificial Sequence
  Description of Artificial Sequence: Synthetic polypeptide
AEEEISTTNPVATEQYGQCVCQNWGEDHNAENFISETQS

SEQ ID NO: 207027 - protein, 39 aa, Artificial Sequence
  Description of Artificial Sequence: Synthetic polypeptide
DDAEISTTNPVATEQYGQCVCSNWGEDHNAENFNSDTQA

SEQ ID NO: 207028 - protein, 39 aa, Artificial Sequence
  Description of Artificial Sequence: Synthetic polypeptide
DDAEISTTNPVATEQYGQCVCSNWGEDHNAENFQSDTQA

SEQ ID NO: 207029 - protein, 39 aa, Artificial Sequence
  Description of Artificial Sequence: Synthetic polypeptide
DDREISTTNPVAYEQYGQCVCSNWGEDHNAENFGSDNQA

SEQ ID NO: 207030 - protein, 37 aa, Artificial Sequence
  Description of Artificial Sequence: Synthetic polypeptide
QAAEIATTNPVATEQYGCVAAGEGGHGNESGEEEGHH

SEQ ID NO: 207031 - protein, 39 aa, Artificial Sequence
  Description of Artificial Sequence: Synthetic polypeptide
DEMEIACTNPVATEQYGQCVCSTWGEDHNAEHFISETQA

SEQ ID NO: 207032 - protein, 39 aa, Artificial Sequence
  Description of Artificial Sequence: Synthetic polypeptide
DDREISTTNPVATEEYGQCVCSNWGEGTNTENFNSETQS

SEQ ID NO: 207033 - protein, 39 aa, Artificial Sequence
  Description of Artificial Sequence: Synthetic polypeptide
DENEISTVNPVATEQYGQCVCSNWGEDHNQENFNSDFQA

SEQ ID NO: 207034 - protein, 40 aa, Artificial Sequence
  Description of Artificial Sequence: Synthetic polypeptide
CEEEISTTNPVATEGYGQCIVCSNWGEDTNAENFNSDNQI

SEQ ID NO: 207035 - protein, 39 aa, Artificial Sequence
  Description of Artificial Sequence: Synthetic polypeptide
CEEEISTTNPVATEGYGQCVCSNWGEDHNQEYFNSDTQA

SEQ ID NO: 207036 - protein, 37 aa, Artificial Sequence
  Description of Artificial Sequence: Synthetic polypeptide
DEAEIRTTNPIATEGWGCQTCFNWEDDAENSGSDNQS

SEQ ID NO: 207037 - protein, 38 aa, Artificial Sequence
  Description of Artificial Sequence: Synthetic polypeptide
DEACISTTNPVATEGYGQCVCSNWGEHNTENFNSDPQS

SEQ ID NO: 207038 - protein, 37 aa, Artificial Sequence
  Description of Artificial Sequence: Synthetic polypeptide
DEDEIATTNPVATASWGTCVAAANWEVADRGGEDDHW

SEQ ID NO: 207039 - protein, 40 aa, Artificial Sequence
  Description of Artificial Sequence: Synthetic polypeptide
DDAEISTTNPVATEQYGQCQVCSTWEEDHNAENFNSDTQN

SEQ ID NO: 207040 - protein, 37 aa, Artificial Sequence
  Description of Artificial Sequence: Synthetic polypeptide
DEDEIATTNPVATASWGTCVAAANWEVADSGGENDSW

SEQ ID NO: 207041 - protein, 39 aa, Artificial Sequence
  Description of Artificial Sequence: Synthetic polypeptide
DDAEISTTNPVATEQYGQCVCSMWGEDHNAENFNSDTQA

SEQ ID NO: 207042 - protein, 39 aa, Artificial Sequence
  Description of Artificial Sequence: Synthetic polypeptide
DDAEISTTNPVATEQYGQCVCSNWEEDHNAEHFISENQA

SEQ ID NO: 207043 - protein, 38 aa, Artificial Sequence
  Description of Artificial Sequence: Synthetic polypeptide
DEDTIRTTNPVATDFYGAVVDGVGGIGDQALIIGNGDG

SEQ ID NO: 207044 - protein, 38 aa, Artificial Sequence
  Description of Artificial Sequence: Synthetic polypeptide
DEMAISTTNPVATEQYGICVCSNWGEPNAENFISDTQA

SEQ ID NO: 207045 - protein, 34 aa, Artificial Sequence
  Description of Artificial Sequence: Synthetic polypeptide
DDSEIASTNPISTECWGATTWAANETWASRVGPR

SEQ ID NO: 207046 - protein, 40 aa, Artificial Sequence
  Description of Artificial Sequence: Synthetic polypeptide
AEEEISTTNPVATEQYGQCAVCSNWGEDPNAENFNSDTQQ

SEQ ID NO: 207047 - protein, 39 aa, Artificial Sequence
  Description of Artificial Sequence: Synthetic polypeptide
AEEEISTTNPVATEQYGQCICSNWGEDDNAENFNSENQA

SEQ ID NO: 207048 - protein, 38 aa, Artificial Sequence
  Description of Artificial Sequence: Synthetic polypeptide
DEMAISTTNPVATEQYGQCFCSNWGEHNIENFISDNQS

SEQ ID NO: 207049 - protein, 37 aa, Artificial Sequence
  Description of Artificial Sequence: Synthetic polypeptide
DEEACEIAATNPVAYEPWGVCAMVINDNQSDGRNGQM

SEQ ID NO: 207050 - protein, 38 aa, Artificial Sequence
  Description of Artificial Sequence: Synthetic polypeptide
DEEACEIAATNPVAYEPWGVCAMWINDAQPSDGRNGNM

SEQ ID NO: 207051 - protein, 36 aa, Artificial Sequence
  Description of Artificial Sequence: Synthetic polypeptide
DEEACEIAATNPVAYEPWGVCAMWINDMQSDGKGQM

SEQ ID NO: 207052 - protein, 39 aa, Artificial Sequence
  Description of Artificial Sequence: Synthetic polypeptide
TEGEIFRTTNPLAYEAYRGITTVSCTIEQEQGLGTNNVM

SEQ ID NO: 207053 - protein, 39 aa, Artificial Sequence
  Description of Artificial Sequence: Synthetic polypeptide
DEEEIRTTNPVAYEGYGQCVCGNWGEDHNAENFNSDNQL

SEQ ID NO: 207054 - protein, 38 aa, Artificial Sequence
  Description of Artificial Sequence: Synthetic polypeptide
DSECINTVNPVAYEQYGCVVPACTDNALAANTAGGLSF

SEQ ID NO: 207055 - protein, 36 aa, Artificial Sequence
  Description of Artificial Sequence: Synthetic polypeptide
DEAEIRTTNPIATEGWGCQTCANAEEDAENSGSETI

SEQ ID NO: 207056 - protein, 35 aa, Artificial Sequence
  Description of Artificial Sequence: Synthetic polypeptide
QENEIATTNPVATAAWGCVAGENGEEMNAALDNDK

SEQ ID NO: 207057 - protein, 37 aa, Artificial Sequence
  Description of Artificial Sequence: Synthetic polypeptide
DEEACEIAATNPVAYEPWGVCAMWINDQQSDGENGQM

SEQ ID NO: 207058 - protein, 39 aa, Artificial Sequence
  Description of Artificial Sequence: Synthetic polypeptide
DDAEISTTNPVATEQYGQCVCSNWGEDHNAEGFNSETQG

SEQ ID NO: 207059 - protein, 35 aa, Artificial Sequence
  Description of Artificial Sequence: Synthetic polypeptide
NTEAEIATTNPVAYEAWGNICATTDNQGEDNNADH

SEQ ID NO: 207060 - protein, 37 aa, Artificial Sequence
  Description of Artificial Sequence: Synthetic polypeptide
DEAEIRTTNPIATEGWGCQTCANAEEHAEYSGSDNQA

SEQ ID NO: 207061 - protein, 38 aa, Artificial Sequence
  Description of Artificial Sequence: Synthetic polypeptide
DEEEIACTNPVATEQYGCNVAAIPNGDEAPADIDESQM

SEQ ID NO: 207062 - protein, 36 aa, Artificial Sequence
  Description of Artificial Sequence: Synthetic polypeptide
DEMELATTNPVAYECWGIAYLGDFAELNGEKRGDMN

SEQ ID NO: 207063 - protein, 38 aa, Artificial Sequence
  Description of Artificial Sequence: Synthetic polypeptide
DENEISTTNPVAYEGYGQCVCSNSGEHNAENFISDNQS

SEQ ID NO: 207064 - protein, 39 aa, Artificial Sequence
  Description of Artificial Sequence: Synthetic polypeptide
DDAEISTTNPVATEQYGQCVCSNWGEDHNIEYFNSDTQG

SEQ ID NO: 207065 - protein, 38 aa, Artificial Sequence
  Description of Artificial Sequence: Synthetic polypeptide
DEACISTTNPVATEGYGCVCSNWGEDHNAENFNSETQA

SEQ ID NO: 207066 - protein, 37 aa, Artificial Sequence
  Description of Artificial Sequence: Synthetic polypeptide
DAQQIATTNPVAYEQWGSICAMTAGIGNATGGDNGVP

SEQ ID NO: 207067 - protein, 40 aa, Artificial Sequence
  Description of Artificial Sequence: Synthetic polypeptide
AEEEISTTNPVATEQYGQCQVCSNWGPDHNAENFNSDTQS

SEQ ID NO: 207068 - protein, 38 aa, Artificial Sequence
  Description of Artificial Sequence: Synthetic polypeptide
DEDEIATTNPVATEQWGCNCAGTGPHPGDNHPDDSTNN

SEQ ID NO: 207069 - protein, 37 aa, Artificial Sequence
  Description of Artificial Sequence: Synthetic polypeptide
DETCISTTNPLATEQWGCVCSNWGEDNAESFNSDTQS

SEQ ID NO: 207070 - protein, 39 aa, Artificial Sequence
  Description of Artificial Sequence: Synthetic polypeptide
AEEEISTTNPVATEQYGQCTCSMWEEDDNAEYINSDTQA

SEQ ID NO: 207071 - protein, 36 aa, Artificial Sequence
  Description of Artificial Sequence: Synthetic polypeptide
DEMEIACTNPVATEQWGTNCAATDGHPVEFEINEDN

SEQ ID NO: 207072 - protein, 39 aa, Artificial Sequence
  Description of Artificial Sequence: Synthetic polypeptide
DDAEISTTNPVATEYYGQCVCSNWGEDHNAENFQSENQA

SEQ ID NO: 207073 - protein, 38 aa, Artificial Sequence
  Description of Artificial Sequence: Synthetic polypeptide
DEDEIATTNPVATEQWGCNCAGTGDHPGVNHPDDSQNN

SEQ ID NO: 207074 - protein, 39 aa, Artificial Sequence
  Description of Artificial Sequence: Synthetic polypeptide
NDEEISTTNPVATEQYGQCVCSNWGEDHNAEFFGSDTQS

SEQ ID NO: 207075 - protein, 37 aa, Artificial Sequence
  Description of Artificial Sequence: Synthetic polypeptide
DEDEIATTNPVATEQWGCCTAGAGDHPGNNHPDDSNN

SEQ ID NO: 207076 - protein, 38 aa, Artificial Sequence
  Description of Artificial Sequence: Synthetic polypeptide
DEDEIATTNPVATEQWGCNCAGTGDHPGDNHPDDAENN

SEQ ID NO: 207077 - protein, 36 aa, Artificial Sequence
  Description of Artificial Sequence: Synthetic polypeptide
DQTVIQTTNPVAYEQWGCVAACTVPPSDARPPGQEP

SEQ ID NO: 207078 - protein, 37 aa, Artificial Sequence
  Description of Artificial Sequence: Synthetic polypeptide
DEAEIRTTNPIATEGWGCQTCQNAEDDAEHSGSDNQA

SEQ ID NO: 207079 - protein, 35 aa, Artificial Sequence
  Description of Artificial Sequence: Synthetic polypeptide
DETCIRTTNPIATECWGATTWANAEDWADPKGPYI

SEQ ID NO: 207080 - protein, 39 aa, Artificial Sequence
  Description of Artificial Sequence: Synthetic polypeptide
DENEISTTNPVAYEQYGQCVCGNWEEEHNAENFQSDNQA

SEQ ID NO: 207081 - protein, 35 aa, Artificial Sequence
  Description of Artificial Sequence: Synthetic polypeptide
DETCIRTTNPIATECWGATTWANAEDWAEPKGPYI

SEQ ID NO: 207082 - protein, 37 aa, Artificial Sequence
  Description of Artificial Sequence: Synthetic polypeptide
DEMAIGTTNPVATEQYGCLCTATDGSPVEFETSDSKQ

SEQ ID NO: 207083 - protein, 39 aa, Artificial Sequence
  Description of Artificial Sequence: Synthetic polypeptide
AEEEISTTNPVATEQYGQCVCGNWGEDDNAENFNSDTQS

SEQ ID NO: 207084 - protein, 39 aa, Artificial Sequence
  Description of Artificial Sequence: Synthetic polypeptide
AEEEISTTNPVATEQYGQCVCGNWGEDHNAENFISDTQG

SEQ ID NO: 207085 - protein, 39 aa, Artificial Sequence
  Description of Artificial Sequence: Synthetic polypeptide
DENEISTTNPVAYEQYGQCVCSNWGEEHNQENFNSETQS

SEQ ID NO: 207086 - protein, 40 aa, Artificial Sequence
  Description of Artificial Sequence: Synthetic polypeptide
DEEEIRTTNPVATEQYGTTWVIHPCSVEEYAEVIMTTQEL

SEQ ID NO: 207087 - protein, 39 aa, Artificial Sequence
  Description of Artificial Sequence: Synthetic polypeptide
DENEISTTNPVAYEQYGQCVCSNWGELHNAENFNSETQA

SEQ ID NO: 207088 - protein, 38 aa, Artificial Sequence
  Description of Artificial Sequence: Synthetic polypeptide
TEMEISTTNPVATEQYGCVCSNWGEDPNAEYFISDTQA

SEQ ID NO: 207089 - protein, 39 aa, Artificial Sequence
  Description of Artificial Sequence: Synthetic polypeptide
DDAEISTTNPVATEQYGQCVCSNWGEDHNAESFNSDTQP

SEQ ID NO: 207090 - protein, 37 aa, Artificial Sequence
  Description of Artificial Sequence: Synthetic polypeptide
DEAEIATTNPVAYYAPQWGGCNVPANMNALAGGDQDA

SEQ ID NO: 207091 - protein, 40 aa, Artificial Sequence
  Description of Artificial Sequence: Synthetic polypeptide
AEEEISTTNPVATEQYGQCQVCSNWEEDHNQEYFNSDTQS

SEQ ID NO: 207092 - protein, 34 aa, Artificial Sequence
  Description of Artificial Sequence: Synthetic polypeptide
QENEIATTNPCAYAPWGNTVAGEGHLQNHMNMVK

SEQ ID NO: 207093 - protein, 37 aa, Artificial Sequence
  Description of Artificial Sequence: Synthetic polypeptide
QTSEIAPTNPCSYEQYGVTVSCCQNMLSQNSNGGTQR

SEQ ID NO: 207094 - protein, 35 aa, Artificial Sequence
  Description of Artificial Sequence: Synthetic polypeptide
DETEIACTNPIATECWGATYYANENDQHEKNGKTM

SEQ ID NO: 207095 - protein, 38 aa, Artificial Sequence
  Description of Artificial Sequence: Synthetic polypeptide
DDAEISTTNPVATEQYGQCVCSNWGEHNAENFFSETQS

SEQ ID NO: 207096 - protein, 38 aa, Artificial Sequence
  Description of Artificial Sequence: Synthetic polypeptide
AEEEIATTNPVATEQWTGCCTAAQGNPDNTAAPGEGNH

SEQ ID NO: 207097 - protein, 39 aa, Artificial Sequence
  Description of Artificial Sequence: Synthetic polypeptide
DQEEISTTNPVATCQYGQCVCSNWGEGDNAENFISDTQA

SEQ ID NO: 207098 - protein, 37 aa, Artificial Sequence
  Description of Artificial Sequence: Synthetic polypeptide
TEHEISTTNPVAYENYGTVQACTGYEGQQNKFGGQHE

SEQ ID NO: 207099 - protein, 35 aa, Artificial Sequence
  Description of Artificial Sequence: Synthetic polypeptide
DETDIRTTNPIATECWGATTWANAEDWGEPKGPYI

SEQ ID NO: 207100 - protein, 37 aa, Artificial Sequence
  Description of Artificial Sequence: Synthetic polypeptide
TEHPIATTNPVAYEQYGVTVVCLGGEPFTNPGEHNDM

SEQ ID NO: 207101 - protein, 37 aa, Artificial Sequence
  Description of Artificial Sequence: Synthetic polypeptide
DEDEIATTNPVATEQWGCCAGHGDHPGPNHPDDSDNN

SEQ ID NO: 207102 - protein, 35 aa, Artificial Sequence
  Description of Artificial Sequence: Synthetic polypeptide
DETDIRTTNPIATECWGATTWANAEDWAEPKGPYI

SEQ ID NO: 207103 - protein, 37 aa, Artificial Sequence
  Description of Artificial Sequence: Synthetic polypeptide
DENEISTTNPVSYEGYGCICSNWEEHNAEQFISDNQA

SEQ ID NO: 207104 - protein, 38 aa, Artificial Sequence
  Description of Artificial Sequence: Synthetic polypeptide
DEEEIRTTNPCATEGYGQCFCSNWGEHNAENFISDTQA

SEQ ID NO: 207105 - protein, 35 aa, Artificial Sequence
  Description of Artificial Sequence: Synthetic polypeptide
DETDIRTTNPIATECWGATTWANAEDWAEPKGPYD

SEQ ID NO: 207106 - protein, 37 aa, Artificial Sequence
  Description of Artificial Sequence: Synthetic polypeptide
DEDEIATTNPVATEQWGCCAGIGDHPGDNHPDDSFNN

SEQ ID NO: 207107 - protein, 39 aa, Artificial Sequence
  Description of Artificial Sequence: Synthetic polypeptide
AEEEISTTNPVATEQYGQCVCQNWGEDHNAENFGSETQS

SEQ ID NO: 207108 - protein, 39 aa, Artificial Sequence
  Description of Artificial Sequence: Synthetic polypeptide
DQGEIRTTNPVATEQYGVACVNGMTLSSNIPEESYDELQ

SEQ ID NO: 207109 - protein, 35 aa, Artificial Sequence
  Description of Artificial Sequence: Synthetic polypeptide
DETAIRTTNPIATECWGATTWANAEDWAEAKGPYI

SEQ ID NO: 207110 - protein, 38 aa, Artificial Sequence
  Description of Artificial Sequence: Synthetic polypeptide
DEAEIRCTNPVAYEQYGCICSNWGEDHNEENFPSDNQA

SEQ ID NO: 207111 - protein, 38 aa, Artificial Sequence
  Description of Artificial Sequence: Synthetic polypeptide
DEACISTTNPVATEGYGCVCSMWGEDHNAENFNSDNQS

SEQ ID NO: 207112 - protein, 40 aa, Artificial Sequence
  Description of Artificial Sequence: Synthetic polypeptide
AEEEISTTNPVATEQYGQCQVCSDWEYDHNQENFNSETQA

SEQ ID NO: 207113 - protein, 40 aa, Artificial Sequence
  Description of Artificial Sequence: Synthetic polypeptide
AEEEISTTNPVATEQYGQCQVCSNWEEDDNTESFNSETQS

SEQ ID NO: 207114 - protein, 35 aa, Artificial Sequence
  Description of Artificial Sequence: Synthetic polypeptide
DETAIRTTNPIATECWGATTWANAEDWKEPKGPYI

SEQ ID NO: 207115 - protein, 40 aa, Artificial Sequence
  Description of Artificial Sequence: Synthetic polypeptide
AEEEISTTNPVATEQYGQCQVCSNWGEDHNAEGFNSDTQS

SEQ ID NO: 207116 - protein, 39 aa, Artificial Sequence
  Description of Artificial Sequence: Synthetic polypeptide
DEEEISTTNPVATEGYGQCVCSNWGEDHDAENFGSDTQS

SEQ ID NO: 207117 - protein, 35 aa, Artificial Sequence
  Description of Artificial Sequence: Synthetic polypeptide
DEDMIRTTNPIATECWGATTWANAEDWAEPKGPYI

SEQ ID NO: 207118 - protein, 38 aa, Artificial Sequence
  Description of Artificial Sequence: Synthetic polypeptide
DEMAISTTNPVATEQYGCVCSNWGEDPNAEFFISDTQA

SEQ ID NO: 207119 - protein, 35 aa, Artificial Sequence
  Description of Artificial Sequence: Synthetic polypeptide
METEIRTTNPIATECWGATTWANAEDTAEPKGPYI

SEQ ID NO: 207120 - protein, 39 aa, Artificial Sequence
  Description of Artificial Sequence: Synthetic polypeptide
DEMEISTTNPVATEQYGQCVCQTWGAGHNIENFMSDTQS

SEQ ID NO: 207121 - protein, 40 aa, Artificial Sequence
  Description of Artificial Sequence: Synthetic polypeptide
DEEEISTTNPVATEGYGQCQVCSNWMEDHNTENFNSETQS

SEQ ID NO: 207122 - protein, 35 aa, Artificial Sequence
  Description of Artificial Sequence: Synthetic polypeptide
METEIRTTNPIATECWGATTWANAEDWAAPKGPYI

SEQ ID NO: 207123 - protein, 36 aa, Artificial Sequence
  Description of Artificial Sequence: Synthetic polypeptide
DEMELATTNPVAYECWGIAYLGDFATQNQAKNEGMN

SEQ ID NO: 207124 - protein, 40 aa, Artificial Sequence
  Description of Artificial Sequence: Synthetic polypeptide
DEECISTTNPVATEQYGQCQVCSNWGEDHNAENFNSQTQS

SEQ ID NO: 207125 - protein, 40 aa, Artificial Sequence
  Description of Artificial Sequence: Synthetic polypeptide
DEEEISTTNPVATEGYGQCQVCSNWGEDHNAENFNSDTQS

SEQ ID NO: 207126 - protein, 40 aa, Artificial Sequence
  Description of Artificial Sequence: Synthetic polypeptide
DEEEISTTNPVATEGYGQCQVCSNWGEDHNAENFNSDTQA

SEQ ID NO: 207127 - protein, 40 aa, Artificial Sequence
  Description of Artificial Sequence: Synthetic polypeptide
DEEEISTTNPVATEGYGQCQVCSNWGEDHNAENFNSDNQA

SEQ ID NO: 207128 - protein, 40 aa, Artificial Sequence
  Description of Artificial Sequence: Synthetic polypeptide
DEEEISTTNPVATEGYGQCQVCSNWGEDHNAENFNSDFQA

SEQ ID NO: 207129 - protein, 39 aa, Artificial Sequence
  Description of Artificial Sequence: Synthetic polypeptide
DEACISTTNPVATEGYGQCVCSTWGEDHNAENFNSDTQS

SEQ ID NO: 207130 - protein, 38 aa, Artificial Sequence
  Description of Artificial Sequence: Synthetic polypeptide
AESEIRTTNPVATEGWGQCVCSNWMEENAEYFGSDTQS

SEQ ID NO: 207131 - protein, 40 aa, Artificial Sequence
  Description of Artificial Sequence: Synthetic polypeptide
DEEEISTTNPVATEGYGQCQVCSNWGEDHNAENFISENQS

SEQ ID NO: 207132 - protein, 39 aa, Artificial Sequence
  Description of Artificial Sequence: Synthetic polypeptide
CEEEISTTNPVATEGYGCQVCSNWGEDHNAENFNSDTQA

SEQ ID NO: 207133 - protein, 35 aa, Artificial Sequence
  Description of Artificial Sequence: Synthetic polypeptide
METEIRTTNPIATECWGCTTWANAEDWAEPKGPYI

SEQ ID NO: 207134 - protein, 40 aa, Artificial Sequence
  Description of Artificial Sequence: Synthetic polypeptide
DEEEISTTNPVATEGYGQCQVCGNWGEDHNAEGFNSDTQS

SEQ ID NO: 207135 - protein, 40 aa, Artificial Sequence
  Description of Artificial Sequence: Synthetic polypeptide
DEEEISTTNPVATEGYGQCIVCSNSGEDHNTENFNSETQA

SEQ ID NO: 207136 - protein, 38 aa, Artificial Sequence
  Description of Artificial Sequence: Synthetic polypeptide
TEEIECEIAATNPVAYECWGSAYGGENNQQRGGQGNTS

SEQ ID NO: 207137 - protein, 39 aa, Artificial Sequence
  Description of Artificial Sequence: Synthetic polypeptide
DEACISTTNPVATEGYGQCVCSTWEEDHNAENFNSDTQA

SEQ ID NO: 207138 - protein, 39 aa, Artificial Sequence
  Description of Artificial Sequence: Synthetic polypeptide
DEEEISTTNPVAYEQYGQCVCSNWGEDDNQENFISETQS

SEQ ID NO: 207139 - protein, 39 aa, Artificial Sequence
  Description of Artificial Sequence: Synthetic polypeptide
DEECISTTNPVATEQWGQCVCSNWGEDHNAENFNSDTQS

SEQ ID NO: 207140 - protein, 36 aa, Artificial Sequence
  Description of Artificial Sequence: Synthetic polypeptide
VESEIRTTNPVSTEPWGCIAPEDGQQQQQQRSGDES

SEQ ID NO: 207141 - protein, 39 aa, Artificial Sequence
  Description of Artificial Sequence: Synthetic polypeptide
DEEEISTTNPVAYEQYGQCVCSNWGEDHNAEFFISDTQA

SEQ ID NO: 207142 - protein, 39 aa, Artificial Sequence
  Description of Artificial Sequence: Synthetic polypeptide
DEECISTTNPVATEQYGQCVCGMWGEDHNAENFNSDTQI

SEQ ID NO: 207143 - protein, 39 aa, Artificial Sequence
  Description of Artificial Sequence: Synthetic polypeptide
DEEEISTTNPVAYEQYGQCVCSNWGEDHNAEGFISETQA

SEQ ID NO: 207144 - protein, 39 aa, Artificial Sequence
  Description of Artificial Sequence: Synthetic polypeptide
DEEEISTTNPVATEGYGQCVCFNWGEDHNTEYFNSDTQA

SEQ ID NO: 207145 - protein, 39 aa, Artificial Sequence
  Description of Artificial Sequence: Synthetic polypeptide
DEEEISTTNPVATEGYGQCVCGNWGEDHNAEFFISENQA

SEQ ID NO: 207146 - protein, 40 aa, Artificial Sequence
  Description of Artificial Sequence: Synthetic polypeptide
SEEEIRTTNPVATEGYGMVDNGQGINDDQQEGGGGEQFGD

SEQ ID NO: 207147 - protein, 39 aa, Artificial Sequence
  Description of Artificial Sequence: Synthetic polypeptide
DEECISTTNPVATEQYGQCVCPNWGEDHNIENFNSQTQS

SEQ ID NO: 207148 - protein, 38 aa, Artificial Sequence
  Description of Artificial Sequence: Synthetic polypeptide
ADECIRTTNPVATEQYGQCVCSNWGEHNQENFISDTQA

SEQ ID NO: 207149 - protein, 39 aa, Artificial Sequence
  Description of Artificial Sequence: Synthetic polypeptide
DEEEISTTNPVATEGYGQCVCSNWEEDHNAENFISDTQS

SEQ ID NO: 207150 - protein, 38 aa, Artificial Sequence
  Description of Artificial Sequence: Synthetic polypeptide
DEEEIACTNPVATEQWGHVVAAGGAGGENTADVNMNMM

SEQ ID NO: 207151 - protein, 39 aa, Artificial Sequence
  Description of Artificial Sequence: Synthetic polypeptide
DEECISTTNPVATEQYGQCVCGNWGEDHNAESFNSDFQA

SEQ ID NO: 207152 - protein, 39 aa, Artificial Sequence
  Description of Artificial Sequence: Synthetic polypeptide
DEEEISTTNPVAYEQYGQCVCSNSGEDHNAENFISQTQS

SEQ ID NO: 207153 - protein, 39 aa, Artificial Sequence
  Description of Artificial Sequence: Synthetic polypeptide
DEECISTTNPVATEQYGQCVCGNWGEDHNAENFNSDTQQ

SEQ ID NO: 207154 - protein, 39 aa, Artificial Sequence
  Description of Artificial Sequence: Synthetic polypeptide
DEEEISTTNPVATEGYGQCVCQNWGEDHNAENFNSDTQQ

SEQ ID NO: 207155 - protein, 39 aa, Artificial Sequence
  Description of Artificial Sequence: Synthetic polypeptide
DEEEISTTNPVATEGYGQCVCQNWGEDHNAENFNSDPQA

SEQ ID NO: 207156 - protein, 38 aa, Artificial Sequence
  Description of Artificial Sequence: Synthetic polypeptide
DEACISTTNPVATEQYGCVCENWGEDPNAEYFNSDTQS

SEQ ID NO: 207157 - protein, 39 aa, Artificial Sequence
  Description of Artificial Sequence: Synthetic polypeptide
DEEEISTTNPVATEGYGQCVCQNWGEDHNAENFNSDNQS

SEQ ID NO: 207158 - protein, 39 aa, Artificial Sequence
  Description of Artificial Sequence: Synthetic polypeptide
DEMEISTTNPVATEQYGQCVCGNWGEDHNAEFFNSENQA

SEQ ID NO: 207159 - protein, 39 aa, Artificial Sequence
  Description of Artificial Sequence: Synthetic polypeptide
DEECISTTNPVATEQYGQCVCGNWGEDHNAENFNSDTQF

SEQ ID NO: 207160 - protein, 39 aa, Artificial Sequence
  Description of Artificial Sequence: Synthetic polypeptide
DEEEISTTNPVATEGYGQCVCPNWGEDHNAENFNSQTQP

SEQ ID NO: 207161 - protein, 39 aa, Artificial Sequence
  Description of Artificial Sequence: Synthetic polypeptide
DEECISTTNPVATEQYGQCVCGNWGEDHNAENFISETQN

SEQ ID NO: 207162 - protein, 39 aa, Artificial Sequence
  Description of Artificial Sequence: Synthetic polypeptide
DEEEISTTNPVATEGYGQCVCGNWGEDHNTENFNSDTQQ

SEQ ID NO: 207163 - protein, 38 aa, Artificial Sequence
  Description of Artificial Sequence: Synthetic polypeptide
DEACISTTNPVATEQYGCTCSMWEEDDNAEYINSDTQS

SEQ ID NO: 207164 - protein, 39 aa, Artificial Sequence
  Description of Artificial Sequence: Synthetic polypeptide
DEEEISTTNPVATEGYGQCVCGNWGEDHNIENFNSETQA

SEQ ID NO: 207165 - protein, 39 aa, Artificial Sequence
  Description of Artificial Sequence: Synthetic polypeptide
DEMEISTTNPVATEQYGQCVCGNWGEDHNAENFNSDTQS

SEQ ID NO: 207166 - protein, 39 aa, Artificial Sequence
  Description of Artificial Sequence: Synthetic polypeptide
DEEEISTTNPVATEGYGQCVCGNWGEDHNAENFNSDNQS

SEQ ID NO: 207167 - protein, 39 aa, Artificial Sequence
  Description of Artificial Sequence: Synthetic polypeptide
DEEEISTTNPVAYEQYGQCVCSNWEEDHNAENFISDTQA

SEQ ID NO: 207168 - protein, 39 aa, Artificial Sequence
  Description of Artificial Sequence: Synthetic polypeptide
DEEEISTTNPVATEGYGQCVCGNWGEDHNAENFISDNQA

SEQ ID NO: 207169 - protein, 39 aa, Artificial Sequence
  Description of Artificial Sequence: Synthetic polypeptide
DEACISTTNPVATEQYGCAVCSNWGEDHNTENFNSETQF

SEQ ID NO: 207170 - protein, 38 aa, Artificial Sequence
  Description of Artificial Sequence: Synthetic polypeptide
DEEEISTTNPVCTEHYGQCVCSNWGEHNAENFISDTQS

SEQ ID NO: 207171 - protein, 38 aa, Artificial Sequence
  Description of Artificial Sequence: Synthetic polypeptide
DEHNEIATTNPVAYERWGEVCSTPNQGNHGEEKGDGHN

SEQ ID NO: 207172 - protein, 39 aa, Artificial Sequence
  Description of Artificial Sequence: Synthetic polypeptide
METEIRTTNPVATEFYGQVVNMQGINNMDNQTGEFTEEG

SEQ ID NO: 207173 - protein, 39 aa, Artificial Sequence
  Description of Artificial Sequence: Synthetic polypeptide
DEEEIATTNPVAYEPQPWGHSACAAANPDAMQPGGDQHQ

SEQ ID NO: 207174 - protein, 38 aa, Artificial Sequence
  Description of Artificial Sequence: Synthetic polypeptide
DDAEISTTNPVATEQYGCVCSNWGEDHNAENFISETQA

SEQ ID NO: 207175 - protein, 39 aa, Artificial Sequence
  Description of Artificial Sequence: Synthetic polypeptide
DEEEIACTNPVATEQWGHVVAAYGGVGGENTHDVNDTSM

SEQ ID NO: 207176 - protein, 38 aa, Artificial Sequence
  Description of Artificial Sequence: Synthetic polypeptide
QEYEIGTTNPVATEAYGATVVSALDGGDEEEEGGNFDI

SEQ ID NO: 207177 - protein, 36 aa, Artificial Sequence
  Description of Artificial Sequence: Synthetic polypeptide
DEDEIATTNPVATASWGCVTAAAGNPDTMNPDEFPH

SEQ ID NO: 207178 - protein, 38 aa, Artificial Sequence
  Description of Artificial Sequence: Synthetic polypeptide
DQAEISTTNPVATCQYGCVCSNWGEGHNAENFISDNQA

SEQ ID NO: 207179 - protein, 39 aa, Artificial Sequence
  Description of Artificial Sequence: Synthetic polypeptide
DQAEISTTNPVATCQYGQCVCSNWGEGDNAENFGSDNQS

SEQ ID NO: 207180 - protein, 38 aa, Artificial Sequence
  Description of Artificial Sequence: Synthetic polypeptide
DETEIACTNPVATEQWGHSAATAGPYPGANGALMGAQD

SEQ ID NO: 207181 - protein, 38 aa, Artificial Sequence
  Description of Artificial Sequence: Synthetic polypeptide
DQAEISTTNPVATEQYGQCFCSNWGEHNAEHFGSDTQA

SEQ ID NO: 207182 - protein, 39 aa, Artificial Sequence
  Description of Artificial Sequence: Synthetic polypeptide
DEEEIRCTNPVATEGYGQCVCSNWGEDDNDEYFISDTQS

SEQ ID NO: 207183 - protein, 37 aa, Artificial Sequence
  Description of Artificial Sequence: Synthetic polypeptide
DQAEISTTNPVAYEQYGCCCSNWGEHNAEHFQSDTQA

SEQ ID NO: 207184 - protein, 37 aa, Artificial Sequence
  Description of Artificial Sequence: Synthetic polypeptide
TEGAEIASTNPVAYEQWGSVVCGNAQLDHVDQSNDHQ

SEQ ID NO: 207185 - protein, 35 aa, Artificial Sequence
  Description of Artificial Sequence: Synthetic polypeptide
QENEIATTNPVATASWGCQAGKPGEEMNAMLDNHN

SEQ ID NO: 207186 - protein, 35 aa, Artificial Sequence
  Description of Artificial Sequence: Synthetic polypeptide
VESEIATTNPVSTEPWGCIAPEDGQQQQQTRGTES

SEQ ID NO: 207187 - protein, 35 aa, Artificial Sequence
  Description of Artificial Sequence: Synthetic polypeptide
DEMEIATTNPVATAQWGTNCAAIDGHPMEFEINND

SEQ ID NO: 207188 - protein, 37 aa, Artificial Sequence
  Description of Artificial Sequence: Synthetic polypeptide
DEDELASTNPVAYEEWGSTVPTDIHNGTDLIGHGGIK

SEQ ID NO: 207189 - protein, 39 aa, Artificial Sequence
  Description of Artificial Sequence: Synthetic polypeptide
TEGCAEIATTNPVAYEQWGSVCTIEDNEMDRRTDRGTKN

SEQ ID NO: 207190 - protein, 39 aa, Artificial Sequence
  Description of Artificial Sequence: Synthetic polypeptide
DEEEISTTNPVAYEYYGQCVCSNWGEDDNIEYFGSDTQS

SEQ ID NO: 207191 - protein, 39 aa, Artificial Sequence
  Description of Artificial Sequence: Synthetic polypeptide
TEGCAEIATTNPVAYEQWGSVCTIEDNEMTRTDRGTGAN

SEQ ID NO: 207192 - protein, 38 aa, Artificial Sequence
  Description of Artificial Sequence: Synthetic polypeptide
DEDELATTNPVAYEQWGSTVPTDIHGLTLNGGHAGQAK

SEQ ID NO: 207193 - protein, 36 aa, Artificial Sequence
  Description of Artificial Sequence: Synthetic polypeptide
QENEIATTNPVATASWGACVAGKGSEMNAMANDNHN

SEQ ID NO: 207194 - protein, 39 aa, Artificial Sequence
  Description of Artificial Sequence: Synthetic polypeptide
DEEEISTTNPVAYEYYGQCVCSNWGEDHNAENFISENQA

SEQ ID NO: 207195 - protein, 37 aa, Artificial Sequence
  Description of Artificial Sequence: Synthetic polypeptide
DETEIACTNPVATEQWGCVAAPPGNSHPEAEDSGEEN

SEQ ID NO: 207196 - protein, 38 aa, Artificial Sequence
  Description of Artificial Sequence: Synthetic polypeptide
DEEEIATTNPVAYEPQWGGCFNCAANNGLIANPDDGAW

SEQ ID NO: 207197 - protein, 38 aa, Artificial Sequence
  Description of Artificial Sequence: Synthetic polypeptide
DAEEIATTNPVATEQWGHCNVAAPMPGLDAGAPMDGAN

SEQ ID NO: 207198 - protein, 39 aa, Artificial Sequence
  Description of Artificial Sequence: Synthetic polypeptide
DEEEIACTNPVATEQWGHVVAANGGAGGENTIDVNDSMM

SEQ ID NO: 207199 - protein, 38 aa, Artificial Sequence
  Description of Artificial Sequence: Synthetic polypeptide
DEEEIACTNPVATEQWGHVVAAGGAGGEVTPDVNDSKM

SEQ ID NO: 207200 - protein, 39 aa, Artificial Sequence
  Description of Artificial Sequence: Synthetic polypeptide
DEEEISTTNPVAYEQYGQCVCSNWGEDHNAENFISDFQL

SEQ ID NO: 207201 - protein, 38 aa, Artificial Sequence
  Description of Artificial Sequence: Synthetic polypeptide
DEEEIRTTNPVAYEGYGCFCSNWPEDHNAEYFDSDTQS

SEQ ID NO: 207202 - protein, 39 aa, Artificial Sequence
  Description of Artificial Sequence: Synthetic polypeptide
DEEEISTTNPVAYEQYGQCVCSNWGEDHNAENFISDPQA

SEQ ID NO: 207203 - protein, 39 aa, Artificial Sequence
  Description of Artificial Sequence: Synthetic polypeptide
DEEEISTTNPVAYEQYGQCVCSNWGEDHNAENFISDTQA

SEQ ID NO: 207204 - protein, 38 aa, Artificial Sequence
  Description of Artificial Sequence: Synthetic polypeptide
DAEEIATTNPVATEQWGHCNVAATAGVPPAEAPGGGMF

SEQ ID NO: 207205 - protein, 39 aa, Artificial Sequence
  Description of Artificial Sequence: Synthetic polypeptide
DEEEISTTNPVAYEQYGQCVCSNWGEDHNAENFISDTQG

SEQ ID NO: 207206 - protein, 39 aa, Artificial Sequence
  Description of Artificial Sequence: Synthetic polypeptide
DEAEIRTTNPVATEQYGQCTCSNWGEDHNAENFISDTQS

SEQ ID NO: 207207 - protein, 38 aa, Artificial Sequence
  Description of Artificial Sequence: Synthetic polypeptide
CEEEISTTNPVATEGYGCVCSNWGEDHNAENFISDTQS

SEQ ID NO: 207208 - protein, 38 aa, Artificial Sequence
  Description of Artificial Sequence: Synthetic polypeptide
CEEEISTTNPVATEGYGCVCSNWGEDHNAENFISETQT

SEQ ID NO: 207209 - protein, 39 aa, Artificial Sequence
  Description of Artificial Sequence: Synthetic polypeptide
DEEEISTTNPVAYEQYGQCVCSNWGEDHNAENFISDTQL

SEQ ID NO: 207210 - protein, 38 aa, Artificial Sequence
  Description of Artificial Sequence: Synthetic polypeptide
AEEEIATTNPVATEQYGCYCFNWGEDDNIEHFNSETQA

SEQ ID NO: 207211 - protein, 34 aa, Artificial Sequence
  Description of Artificial Sequence: Synthetic polypeptide
QENEIATTNPVATASWGCVAGEGEEMNAALDDDT

SEQ ID NO: 207212 - protein, 39 aa, Artificial Sequence
  Description of Artificial Sequence: Synthetic polypeptide
DEEEISTTNPVAYEQYGQCVCSNWGEDHNAENFISDTQS

SEQ ID NO: 207213 - protein, 38 aa, Artificial Sequence
  Description of Artificial Sequence: Synthetic polypeptide
DEEEIACTNPVATEQWGHVVAAGGAGGENTPDVNDSMD

SEQ ID NO: 207214 - protein, 38 aa, Artificial Sequence
  Description of Artificial Sequence: Synthetic polypeptide
CEEEISTTNPVATEGYGCVCSNWGEDHNQENFFSDTQA

SEQ ID NO: 207215 - protein, 37 aa, Artificial Sequence
  Description of Artificial Sequence: Synthetic polypeptide
MEVEIKTTNPAATEIYGMSEDGDENMDPGNMDDAIDD

SEQ ID NO: 207216 - protein, 36 aa, Artificial Sequence
  Description of Artificial Sequence: Synthetic polypeptide
VESEIRTTNPVSTEPWGCIAPEDGQQQQQQRKGTSS

SEQ ID NO: 207217 - protein, 37 aa, Artificial Sequence
  Description of Artificial Sequence: Synthetic polypeptide
TEEQISTTNPVAYESYGTVQACTGYEGQQNKFGGQIE

SEQ ID NO: 207218 - protein, 39 aa, Artificial Sequence
  Description of Artificial Sequence: Synthetic polypeptide
DDAEISTTNPVATEGYGQCVCSTWGEDHNAEYFNSENQA

SEQ ID NO: 207219 - protein, 38 aa, Artificial Sequence
  Description of Artificial Sequence: Synthetic polypeptide
QEYEIATTNCVATEQYGVVAGPGETGEGGQGGGEEDTF

SEQ ID NO: 207220 - protein, 38 aa, Artificial Sequence
  Description of Artificial Sequence: Synthetic polypeptide
DDAEISTTNPVATEQYGCVCGNWGEDHNAENFNSETQP

SEQ ID NO: 207221 - protein, 35 aa, Artificial Sequence
  Description of Artificial Sequence: Synthetic polypeptide
VESEIRTTNPVSTEPWGCIAPEDGQQQQQQEGQES

SEQ ID NO: 207222 - protein, 39 aa, Artificial Sequence
  Description of Artificial Sequence: Synthetic polypeptide
DEEEIATTNPVAYEPQWGHSACAAANGDPAMQAGADQHQ

SEQ ID NO: 207223 - protein, 38 aa, Artificial Sequence
  Description of Artificial Sequence: Synthetic polypeptide
DEEEIATTNPVAYEPQWGHSACAAANGDAMPPWNDQHQ

SEQ ID NO: 207224 - protein, 39 aa, Artificial Sequence
  Description of Artificial Sequence: Synthetic polypeptide
DEEEISTTNPVAYEGYGQCVCGNWGEDDNQENFNSETQA

SEQ ID NO: 207225 - protein, 38 aa, Artificial Sequence
  Description of Artificial Sequence: Synthetic polypeptide
CEMAISTTNPVATEQYGCVCSNWGEDHNAENFNSDNQA

SEQ ID NO: 207226 - protein, 36 aa, Artificial Sequence
  Description of Artificial Sequence: Synthetic polypeptide
DEFEIRTTNPIATECWGATTWANAEDNWAEPKGPYI

SEQ ID NO: 207227 - protein, 39 aa, Artificial Sequence
  Description of Artificial Sequence: Synthetic polypeptide
ADEEISTTNPVATEQYGQCVCSNWGEGHNAEGFNSDNQS

SEQ ID NO: 207228 - protein, 38 aa, Artificial Sequence
  Description of Artificial Sequence: Synthetic polypeptide
DENEIRTTNPVAYEQWGCVCSNWGEDDNAEYSISDTAS

SEQ ID NO: 207229 - protein, 38 aa, Artificial Sequence
  Description of Artificial Sequence: Synthetic polypeptide
CQGEIRTTNPVATEQYGVACVNNMTLSNIPEESTDELQ

SEQ ID NO: 207230 - protein, 39 aa, Artificial Sequence
  Description of Artificial Sequence: Synthetic polypeptide
DDMEISTTNPVATEQYGQCVCSNWGEDHNAENFNSDTQS

SEQ ID NO: 207231 - protein, 38 aa, Artificial Sequence
  Description of Artificial Sequence: Synthetic polypeptide
DENEIRTTNPVAYEIYGQCVCSNWGEHNAENFISDTQS

SEQ ID NO: 207232 - protein, 38 aa, Artificial Sequence
  Description of Artificial Sequence: Synthetic polypeptide
DENEIRTTNPVAYEIYGCVCSNWMEDDNAENFISDTQS

SEQ ID NO: 207233 - protein, 38 aa, Artificial Sequence
  Description of Artificial Sequence: Synthetic polypeptide
DENEIRTTNPVAYEGWGQCVTSNWGEENTENFISDTQS

SEQ ID NO: 207234 - protein, 37 aa, Artificial Sequence
  Description of Artificial Sequence: Synthetic polypeptide
DENEIRTTNPVAYEGWGCVCSNSGPENAENFSSDTAS

SEQ ID NO: 207235 - protein, 37 aa, Artificial Sequence
  Description of Artificial Sequence: Synthetic polypeptide
QAEEIATTNPVATEQWGHCNVAANNGDTATAPGGVHA

SEQ ID NO: 207236 - protein, 36 aa, Artificial Sequence
  Description of Artificial Sequence: Synthetic polypeptide
DEAEIATTNPVAYEQWGPNCIAGEHGGENPAGQHMD

SEQ ID NO: 207237 - protein, 40 aa, Artificial Sequence
  Description of Artificial Sequence: Synthetic polypeptide
YEGEIRTIVTTNPVATEQYGAAVDGGNEDLEGGMQGQEDD

SEQ ID NO: 207238 - protein, 39 aa, Artificial Sequence
  Description of Artificial Sequence: Synthetic polypeptide
DDMEISTTNPVATEQYGQCVCSNWGEDHNAENFNSQTQS

SEQ ID NO: 207239 - protein, 36 aa, Artificial Sequence
  Description of Artificial Sequence: Synthetic polypeptide
QEEEIATTNPVAYEWYGCHAPWCEHEFSHQHAEGEW

SEQ ID NO: 207240 - protein, 37 aa, Artificial Sequence
  Description of Artificial Sequence: Synthetic polypeptide
AENEIACTNPVAYEQYGCSCSWMEDHNAEYFGSDTQS

SEQ ID NO: 207241 - protein, 36 aa, Artificial Sequence
  Description of Artificial Sequence: Synthetic polypeptide
DETEIATTNPIATECWGVTTWANATDGPAEPAGPKN

SEQ ID NO: 207242 - protein, 35 aa, Artificial Sequence
  Description of Artificial Sequence: Synthetic polypeptide
TESEICTTNPVAYGPYGQTSSCWSASSNSAVTSEE

SEQ ID NO: 207243 - protein, 40 aa, Artificial Sequence
  Description of Artificial Sequence: Synthetic polypeptide
DEEEISTTNPVATCQYGQCQVCSNWGEDHNAENFNSDNQS

SEQ ID NO: 207244 - protein, 37 aa, Artificial Sequence
  Description of Artificial Sequence: Synthetic polypeptide
AENEIACTNPVAYEQYGCSCSWGEDDNQENFGSQTQS

SEQ ID NO: 207245 - protein, 38 aa, Artificial Sequence
  Description of Artificial Sequence: Synthetic polypeptide
AEEEISTTNPVATEGYGCVCGNWGEDHNAENFNSDNQA

SEQ ID NO: 207246 - protein, 37 aa, Artificial Sequence
  Description of Artificial Sequence: Synthetic polypeptide
AENEIACTNPVAYEQYGCSCSNWGEDNAENFNSQTQS

SEQ ID NO: 207247 - protein, 39 aa, Artificial Sequence
  Description of Artificial Sequence: Synthetic polypeptide
AEEEISTTNPVATEEYGQCVCSNWGEDHNAENFNSDTQA

SEQ ID NO: 207248 - protein, 36 aa, Artificial Sequence
  Description of Artificial Sequence: Synthetic polypeptide
QEEEIATTNPVAYEVYGEHAPWCEHEFSQHASGEWQ

SEQ ID NO: 207249 - protein, 36 aa, Artificial Sequence
  Description of Artificial Sequence: Synthetic polypeptide
AENEIACTNPVGTEGYGVSCGSGEHNAEHFGSDTQS

SEQ ID NO: 207250 - protein, 36 aa, Artificial Sequence
  Description of Artificial Sequence: Synthetic polypeptide
DEVEIRTTNPIATECWGATTWANAEDWNAEPKGPYI

SEQ ID NO: 207251 - protein, 39 aa, Artificial Sequence
  Description of Artificial Sequence: Synthetic polypeptide
ADEEISTTNPVATEQYGQCVCSNWGEDHNAENFNSQTQA

SEQ ID NO: 207252 - protein, 37 aa, Artificial Sequence
  Description of Artificial Sequence: Synthetic polypeptide
SEEEISCTNPVAYEGYGCVCSNWGEHNAENFGSDTQS

SEQ ID NO: 207253 - protein, 39 aa, Artificial Sequence
  Description of Artificial Sequence: Synthetic polypeptide
ADEEISTTNPVATEQYGQCVCSNWGEDHNAEYFNSDTQS

SEQ ID NO: 207254 - protein, 37 aa, Artificial Sequence
  Description of Artificial Sequence: Synthetic polypeptide
AEEAIACVNPVCTEQYGCVCSNWGEHNAESFGSDNQA

SEQ ID NO: 207255 - protein, 39 aa, Artificial Sequence
  Description of Artificial Sequence: Synthetic polypeptide
ADEEISTTNPVATEQYGQCVCSNWGEDPNAENFGSETQS

SEQ ID NO: 207256 - protein, 36 aa, Artificial Sequence
  Description of Artificial Sequence: Synthetic polypeptide
DETEIATTNPIATEPWGATTTAGATDGPAQPKGPVN

SEQ ID NO: 207257 - protein, 39 aa, Artificial Sequence
  Description of Artificial Sequence: Synthetic polypeptide
AEEEISTTNPCATEQYGQCVCSNWGEDHNAENFNSDTQA

SEQ ID NO: 207258 - protein, 36 aa, Artificial Sequence
  Description of Artificial Sequence: Synthetic polypeptide
DETEIATTNPIATEPWGATTSAGATDGPAEPKGPYK

SEQ ID NO: 207259 - protein, 39 aa, Artificial Sequence
  Description of Artificial Sequence: Synthetic polypeptide
DESFEVIRTVNPIVAYEAWGSTVVSCCGGAFGNQVGNFE

SEQ ID NO: 207260 - protein, 38 aa, Artificial Sequence
  Description of Artificial Sequence: Synthetic polypeptide
DENEIRTTNPVAYEQWGICVCSNSGEDNAEYFISDTAS

SEQ ID NO: 207261 - protein, 37 aa, Artificial Sequence
  Description of Artificial Sequence: Synthetic polypeptide
DEAEIATTNPVAYEQWGPNCIAGEHGGENPAGGNTFD

SEQ ID NO: 207262 - protein, 39 aa, Artificial Sequence
  Description of Artificial Sequence: Synthetic polypeptide
DDMEISTTNPVATEQYGQCVCSNWGEDHNAEGFNSDNQS

SEQ ID NO: 207263 - protein, 39 aa, Artificial Sequence
  Description of Artificial Sequence: Synthetic polypeptide
SEEEISTTNPVATEEYGQCVCSNWGEDHNAENFNSDTQS

SEQ ID NO: 207264 - protein, 39 aa, Artificial Sequence
  Description of Artificial Sequence: Synthetic polypeptide
DDMEISTTNPVATEQYGQCVCSNWGEDHNAENFNSDTQA

SEQ ID NO: 207265 - protein, 39 aa, Artificial Sequence
  Description of Artificial Sequence: Synthetic polypeptide
AEEEISTTNPCATEQYGQCVCSNWGEDHNAENFNSDTQS

SEQ ID NO: 207266 - protein, 39 aa, Artificial Sequence
  Description of Artificial Sequence: Synthetic polypeptide
DDMEISTTNPVATEQYGQCVCSNWGEDHNAENFNSDTQM

SEQ ID NO: 207267 - protein, 39 aa, Artificial Sequence
  Description of Artificial Sequence: Synthetic polypeptide
AEEEISTTNPCATEQYGQCVCSNWGEDHNAENFNSETQS

SEQ ID NO: 207268 - protein, 37 aa, Artificial Sequence
  Description of Artificial Sequence: Synthetic polypeptide
DEMEISTTNPVAYEGWGQCVCSWGEENQEYFGSDTQA

SEQ ID NO: 207269 - protein, 39 aa, Artificial Sequence
  Description of Artificial Sequence: Synthetic polypeptide
ADEEISTTNPVATEQYGQCVCSNWGEDPNAENFNSQTQA

SEQ ID NO: 207270 - protein, 39 aa, Artificial Sequence
  Description of Artificial Sequence: Synthetic polypeptide
DEECISTTNPVATEGYGQCVCSNWGEDHNAENFGSETQS

SEQ ID NO: 207271 - protein, 35 aa, Artificial Sequence
  Description of Artificial Sequence: Synthetic polypeptide
DENEIATTNPVAYAVWGTSACAAANGDAMQGDQHQ

SEQ ID NO: 207272 - protein, 38 aa, Artificial Sequence
  Description of Artificial Sequence: Synthetic polypeptide
AENEIACTNPVAYEQYGCSCSNWGEADNAEYFGSDNQS

SEQ ID NO: 207273 - protein, 38 aa, Artificial Sequence
  Description of Artificial Sequence: Synthetic polypeptide
AEEEISTTNPVATEGYGCVCSDWGEDDNAENFSSDTQA

SEQ ID NO: 207274 - protein, 36 aa, Artificial Sequence
  Description of Artificial Sequence: Synthetic polypeptide
DENEIATTNPVAYAQWGPCNVAGEGEEMNAALDNHS

SEQ ID NO: 207275 - protein, 36 aa, Artificial Sequence
  Description of Artificial Sequence: Synthetic polypeptide
DETEIATTNPIATECWGVATGPANAADWAEPKGPYY

SEQ ID NO: 207276 - protein, 35 aa, Artificial Sequence
  Description of Artificial Sequence: Synthetic polypeptide
DETEIATTNPIATECWGATYYANENDGHEKTGVTY

SEQ ID NO: 207277 - protein, 35 aa, Artificial Sequence
  Description of Artificial Sequence: Synthetic polypeptide
DETEIATTNPIATECWGATYYANENDGHEKKGKGH

SEQ ID NO: 207278 - protein, 35 aa, Artificial Sequence
  Description of Artificial Sequence: Synthetic polypeptide
DETEIATTNPIATECWGATYYANENDGHEKFGDQM

SEQ ID NO: 207279 - protein, 35 aa, Artificial Sequence
  Description of Artificial Sequence: Synthetic polypeptide
DETEIATTNPIATECWGATYYANENDEHEKTGKQM

SEQ ID NO: 207280 - protein, 39 aa, Artificial Sequence
  Description of Artificial Sequence: Synthetic polypeptide
DEMAISTTNPVATEQYGQCVCSMWEEDHNQESFNSDNQS

SEQ ID NO: 207281 - protein, 35 aa, Artificial Sequence
  Description of Artificial Sequence: Synthetic polypeptide
CETEIATTNPVATAAWGCVAGEGEEMNAALIDNFD

SEQ ID NO: 207282 - protein, 35 aa, Artificial Sequence
  Description of Artificial Sequence: Synthetic polypeptide
CETEIATTNPIATECWGATYYANENDQHEKTGKGM

SEQ ID NO: 207283 - protein, 38 aa, Artificial Sequence
  Description of Artificial Sequence: Synthetic polypeptide
SEEEISTTNPVATEGYGCVCSNWGEDHNAEHFMSDTQA

SEQ ID NO: 207284 - protein, 35 aa, Artificial Sequence
  Description of Artificial Sequence: Synthetic polypeptide
DETEIATTNPIATECWGATYYANEDDGHEKTGKQH

SEQ ID NO: 207285 - protein, 37 aa, Artificial Sequence
  Description of Artificial Sequence: Synthetic polypeptide
DDMEISTTNPVAYEGYGCVCSNWGEPNAENFGSDTQA

SEQ ID NO: 207286 - protein, 38 aa, Artificial Sequence
  Description of Artificial Sequence: Synthetic polypeptide
DEEEIATTNPVAYEAQYGCTIPNPNVGPWEASIHEQTS

SEQ ID NO: 207287 - protein, 37 aa, Artificial Sequence
  Description of Artificial Sequence: Synthetic polypeptide
DEMEISTTNPVAYCGYGCVCSNWGEPNAEFFNSDTQA

SEQ ID NO: 207288 - protein, 39 aa, Artificial Sequence
  Description of Artificial Sequence: Synthetic polypeptide
DEAEISTTNPVATEQYGQCVCGNWGEDHNAENFNSDTQQ

SEQ ID NO: 207289 - protein, 38 aa, Artificial Sequence
  Description of Artificial Sequence: Synthetic polypeptide
DEMEISTTNPVAYEGYGCVTSTWGADHNAEHFISDPQS

SEQ ID NO: 207290 - protein, 35 aa, Artificial Sequence
  Description of Artificial Sequence: Synthetic polypeptide
DESEVRTTNPIATECWGATTWANNEDWAEPVGPYI

SEQ ID NO: 207291 - protein, 40 aa, Artificial Sequence
  Description of Artificial Sequence: Synthetic polypeptide
DEEEIRTTNPVAYEPYQKQFVNSSNSVVEEQMDNTQFQDY

SEQ ID NO: 207292 - protein, 37 aa, Artificial Sequence
  Description of Artificial Sequence: Synthetic polypeptide
CEEEIACTNPVATEQYGSACAPIGHHDIAEAGIGPDD

SEQ ID NO: 207293 - protein, 37 aa, Artificial Sequence
  Description of Artificial Sequence: Synthetic polypeptide
CEGEIATTNPVATAQWGHVVAANPGNGEYGAEGDGNT

SEQ ID NO: 207294 - protein, 38 aa, Artificial Sequence
  Description of Artificial Sequence: Synthetic polypeptide
DENNEIATTNPVAYEAWGVVWPGPNNENDQGAQGNGEM

SEQ ID NO: 207295 - protein, 35 aa, Artificial Sequence
  Description of Artificial Sequence: Synthetic polypeptide
DETEIATTNPIATECWGATTWSNEEDWAEPKGPYI

SEQ ID NO: 207296 - protein, 39 aa, Artificial Sequence
  Description of Artificial Sequence: Synthetic polypeptide
AEEEISTTNPVATEGYGQCVCSNWGEDDNIENFNSDTQS

SEQ ID NO: 207297 - protein, 35 aa, Artificial Sequence
  Description of Artificial Sequence: Synthetic polypeptide
DETEIATTNPIATECWGATYYANENDGMEKTDKQM

SEQ ID NO: 207298 - protein, 39 aa, Artificial Sequence
  Description of Artificial Sequence: Synthetic polypeptide
DEECISTTNPVATEGYGQCVCSNWGEDHNAENSNSDFQP

SEQ ID NO: 207299 - protein, 37 aa, Artificial Sequence
  Description of Artificial Sequence: Synthetic polypeptide
DETEIATTNPIATECWGATYYANENDHQHEKTGRGMS

SEQ ID NO: 207300 - protein, 35 aa, Artificial Sequence
  Description of Artificial Sequence: Synthetic polypeptide
DESEVRTTNPIATEGWGATTWANNEDWAEPVGPYI

SEQ ID NO: 207301 - protein, 35 aa, Artificial Sequence
  Description of Artificial Sequence: Synthetic polypeptide
DDSEIATTNPVSTEGWGATVWAAAEDIAEPKGQYR

SEQ ID NO: 207302 - protein, 35 aa, Artificial Sequence
  Description of Artificial Sequence: Synthetic polypeptide
DDSEIATTNPVSTEGWGATVWAAAEDIAEPKGPYR

SEQ ID NO: 207303 - protein, 35 aa, Artificial Sequence
  Description of Artificial Sequence: Synthetic polypeptide
CETEIRTTNPIATECWGATTWCNAEDWAEPKGPYI

SEQ ID NO: 207304 - protein, 39 aa, Artificial Sequence
  Description of Artificial Sequence: Synthetic polypeptide
DEACISTTNPVATEQYGQCVCSMWGEDHNAENFNSDTQA

SEQ ID NO: 207305 - protein, 36 aa, Artificial Sequence
  Description of Artificial Sequence: Synthetic polypeptide
DETEIATTNPIATECWGATYYMNENDQHEKTGKGMM

SEQ ID NO: 207306 - protein, 38 aa, Artificial Sequence
  Description of Artificial Sequence: Synthetic polypeptide
SEEEISTTNPVATEGYGCVCGNWGADHNAENFGSDTQS

SEQ ID NO: 207307 - protein, 36 aa, Artificial Sequence
  Description of Artificial Sequence: Synthetic polypeptide
DETEIATTNPIATECWGATYYANENDQHEKTQYGMS

SEQ ID NO: 207308 - protein, 36 aa, Artificial Sequence
  Description of Artificial Sequence: Synthetic polypeptide
DETEIATTNPIATECWGATYYANENDQHEKTGKTQS

SEQ ID NO: 207309 - protein, 36 aa, Artificial Sequence
  Description of Artificial Sequence: Synthetic polypeptide
DETEIATTNPIATECWGATYYANENDQHEKTGAQGM

SEQ ID NO: 207310 - protein, 36 aa, Artificial Sequence
  Description of Artificial Sequence: Synthetic polypeptide
DETEIATTNPIATECWGATYYANENDQHEKISKGQS

SEQ ID NO: 207311 - protein, 35 aa, Artificial Sequence
  Description of Artificial Sequence: Synthetic polypeptide
DETEIATTNPIATECWGATYYANENDQHEKDPKGM

SEQ ID NO: 207312 - protein, 36 aa, Artificial Sequence
  Description of Artificial Sequence: Synthetic polypeptide
DETEIATTNPIATECWGATYYANENDQHEHTEKGMS

SEQ ID NO: 207313 - protein, 36 aa, Artificial Sequence
  Description of Artificial Sequence: Synthetic polypeptide
DETEIATTNPIATECWGATYYANENDNQHEKTNKTM

SEQ ID NO: 207314 - protein, 38 aa, Artificial Sequence
  Description of Artificial Sequence: Synthetic polypeptide
AEEAISTTNPVATEGYGCVCSNWGEDHNAENFNSDNQS

SEQ ID NO: 207315 - protein, 39 aa, Artificial Sequence
  Description of Artificial Sequence: Synthetic polypeptide
DEEEISTTNPVATCQYGQCVCGNWGEDHNAENFNSDTQS

SEQ ID NO: 207316 - protein, 39 aa, Artificial Sequence
  Description of Artificial Sequence: Synthetic polypeptide
DEECISTTNPVATEGYGQCVCSNWGEDHNAESFNSDTQS

SEQ ID NO: 207317 - protein, 35 aa, Artificial Sequence
  Description of Artificial Sequence: Synthetic polypeptide
CETEIRTTNPIATECWGATTWANAEDWAEPKGPYI

SEQ ID NO: 207318 - protein, 38 aa, Artificial Sequence
  Description of Artificial Sequence: Synthetic polypeptide
DEMAIRTTNPVAYEQYGQCFCSNWGEHNIENFNSDNQS

SEQ ID NO: 207319 - protein, 35 aa, Artificial Sequence
  Description of Artificial Sequence: Synthetic polypeptide
DESEVRTTNPIATEGWGATTWANNETWAEPVGPYI

SEQ ID NO: 207320 - protein, 39 aa, Artificial Sequence
  Description of Artificial Sequence: Synthetic polypeptide
AEEEISTTNPVATEGYGQCVCGNWGEGHNAENFNSDNQA

SEQ ID NO: 207321 - protein, 39 aa, Artificial Sequence
  Description of Artificial Sequence: Synthetic polypeptide
AEEEISTTNPVATEQYGQCVCSNWGEDHNAENFISETQS

SEQ ID NO: 207322 - protein, 37 aa, Artificial Sequence
  Description of Artificial Sequence: Synthetic polypeptide
AENEIATTNPVAYEGYGCVCSNWGEDNIEHFISENQA

SEQ ID NO: 207323 - protein, 39 aa, Artificial Sequence
  Description of Artificial Sequence: Synthetic polypeptide
DEAEISTTNPVATEQYGQCVCGNWGEDDNAENFNSETQA

SEQ ID NO: 207324 - protein, 39 aa, Artificial Sequence
  Description of Artificial Sequence: Synthetic polypeptide
DEECISTTNPVATEGYGQCVCSNWGEDHNAENFNSDTQS

SEQ ID NO: 207325 - protein, 39 aa, Artificial Sequence
  Description of Artificial Sequence: Synthetic polypeptide
ADEEISTTNPVATEQYGQCVCSNWGEDHNAENFNSDTQP

SEQ ID NO: 207326 - protein, 38 aa, Artificial Sequence
  Description of Artificial Sequence: Synthetic polypeptide
DEAEISTTNPVATEQFGTCVCSNWGYDNAEHFISDTQS

SEQ ID NO: 207327 - protein, 38 aa, Artificial Sequence
  Description of Artificial Sequence: Synthetic polypeptide
SEEEIRTTNPVAYEQWGHNTVYYWEHQQHGRETLDAEE

SEQ ID NO: 207328 - protein, 39 aa, Artificial Sequence
  Description of Artificial Sequence: Synthetic polypeptide
FEEFEIRATNPVATEQYGYVCVHPSPVNMSNAVDMFFEI

SEQ ID NO: 207329 - protein, 39 aa, Artificial Sequence
  Description of Artificial Sequence: Synthetic polypeptide
AEEAISTTNPVAYEQYGQCVCSTWGEDHNAENFNSDTQN

SEQ ID NO: 207330 - protein, 38 aa, Artificial Sequence
  Description of Artificial Sequence: Synthetic polypeptide
SEEEIRTTNPVAYEQWGHNTVYYWEHQQHARPTLDAEP

SEQ ID NO: 207331 - protein, 38 aa, Artificial Sequence
  Description of Artificial Sequence: Synthetic polypeptide
SEEEIRTTNPVAYEQWGHNTVYYWEEHQQHGRPTLDAE

SEQ ID NO: 207332 - protein, 39 aa, Artificial Sequence
  Description of Artificial Sequence: Synthetic polypeptide
CEEEISTTNPVAYEQYGQCVCSNWGEDDNAENFNSDTQS

SEQ ID NO: 207333 - protein, 39 aa, Artificial Sequence
  Description of Artificial Sequence: Synthetic polypeptide
DEECISTTNPVATEGYGQCVCSNWGEDHNAENFISDNQS

SEQ ID NO: 207334 - protein, 38 aa, Artificial Sequence
  Description of Artificial Sequence: Synthetic polypeptide
DEDEIATTNPVATASWGACVAAANNAEVQDDGGENTND

SEQ ID NO: 207335 - protein, 37 aa, Artificial Sequence
  Description of Artificial Sequence: Synthetic polypeptide
DEVEIATTNPVAYAQWGPSACAAANGDAMQATNDQHA

SEQ ID NO: 207336 - protein, 35 aa, Artificial Sequence
  Description of Artificial Sequence: Synthetic polypeptide
DEAENATTNPCAYECWGCVAGPNGNQQLQGDHQHQ

SEQ ID NO: 207337 - protein, 39 aa, Artificial Sequence
  Description of Artificial Sequence: Synthetic polypeptide
DEAEISTTNPVATEQYGQCVCGNWGEDHNAENFPSDNQS

SEQ ID NO: 207338 - protein, 39 aa, Artificial Sequence
  Description of Artificial Sequence: Synthetic polypeptide
DEECISTTNPVAYEAYGQCVCSTWGEDHNTENFNSDTQS

SEQ ID NO: 207339 - protein, 39 aa, Artificial Sequence
  Description of Artificial Sequence: Synthetic polypeptide
SEEEIRTTNPVAYEGYGQCVCSNWMEDHNQENFGSQTQA

SEQ ID NO: 207340 - protein, 38 aa, Artificial Sequence
  Description of Artificial Sequence: Synthetic polypeptide
DENEIRTTNPVSTEGYGQCICSNWEEPNAEYFGSDTQA

SEQ ID NO: 207341 - protein, 35 aa, Artificial Sequence
  Description of Artificial Sequence: Synthetic polypeptide
CEDVIACTNPVATAQWGGCVAANNLPEAPGGQAHH

SEQ ID NO: 207342 - protein, 38 aa, Artificial Sequence
  Description of Artificial Sequence: Synthetic polypeptide
DDACISTTNPVATEQYGQCVCSNWGEHNAENFNSQTQS

SEQ ID NO: 207343 - protein, 37 aa, Artificial Sequence
  Description of Artificial Sequence: Synthetic polypeptide
DENEISTTNPVATEAWGCVCSNSGEDNAEYSISDTAS

SEQ ID NO: 207344 - protein, 37 aa, Artificial Sequence
  Description of Artificial Sequence: Synthetic polypeptide
DETEIATTNPVATAQWGCVAGPTGEPGDEHMNIDQHE

SEQ ID NO: 207345 - protein, 38 aa, Artificial Sequence
  Description of Artificial Sequence: Synthetic polypeptide
DENEIRTTNPVSTEGYGQCICSNWEEHNAENFSSDNQA

SEQ ID NO: 207346 - protein, 35 aa, Artificial Sequence
  Description of Artificial Sequence: Synthetic polypeptide
DENMIATTNPTAYEQWGATYYNIEIEMNQRTMDHG

SEQ ID NO: 207347 - protein, 39 aa, Artificial Sequence
  Description of Artificial Sequence: Synthetic polypeptide
DEECISTTNPVATEQYGQCVCVNWGEDHNAENFNSETQS

SEQ ID NO: 207348 - protein, 39 aa, Artificial Sequence
  Description of Artificial Sequence: Synthetic polypeptide
DEECISTTNPVATEQYGQCVCYNWEEDHNAENFNSDTQS

SEQ ID NO: 207349 - protein, 38 aa, Artificial Sequence
  Description of Artificial Sequence: Synthetic polypeptide
DEEEIATTNPVATAQWGGCCAGNFAGLEATANGPEEFT

SEQ ID NO: 207350 - protein, 34 aa, Artificial Sequence
  Description of Artificial Sequence: Synthetic polypeptide
AESEIASTNPVGTEHWGVCAPTDRDQHQGQDDIM

SEQ ID NO: 207351 - protein, 34 aa, Artificial Sequence
  Description of Artificial Sequence: Synthetic polypeptide
AESEIASTNPVGTEHWGVCAPTERDQHQGQDDSH

SEQ ID NO: 207352 - protein, 37 aa, Artificial Sequence
  Description of Artificial Sequence: Synthetic polypeptide
AENEIATTNPVATEGYGQCVCSNWGEDNQHFISETLA

SEQ ID NO: 207353 - protein, 36 aa, Artificial Sequence
  Description of Artificial Sequence: Synthetic polypeptide
DEAENATTNPVAYEAWGVVWPGPNNENDNGDQNGSE

SEQ ID NO: 207354 - protein, 38 aa, Artificial Sequence
  Description of Artificial Sequence: Synthetic polypeptide
AEEEIGTTNPVAYEQYGCVCSNWGEDHNAENFSSDTQA

SEQ ID NO: 207355 - protein, 38 aa, Artificial Sequence
  Description of Artificial Sequence: Synthetic polypeptide
DAEEIATTNPVATEQWGCVAAGPNPAPEAGTPMEDTHV

SEQ ID NO: 207356 - protein, 37 aa, Artificial Sequence
  Description of Artificial Sequence: Synthetic polypeptide
DEEEISTTNPEAYCQYGCVCPNWGEDNQEYFISDTQA

SEQ ID NO: 207357 - protein, 39 aa, Artificial Sequence
  Description of Artificial Sequence: Synthetic polypeptide
DEECISTTNPVAYCGYGQCVCSNWGEDHNTENFQSDNQS

SEQ ID NO: 207358 - protein, 39 aa, Artificial Sequence
  Description of Artificial Sequence: Synthetic polypeptide
DEEEISTTNPEATEQYGQCVCPNWGEDDNAEYFNSDTQS

SEQ ID NO: 207359 - protein, 34 aa, Artificial Sequence
  Description of Artificial Sequence: Synthetic polypeptide
DESEVRTTNPISTECWGATWANNETWAEPKGPYI

SEQ ID NO: 207360 - protein, 39 aa, Artificial Sequence
  Description of Artificial Sequence: Synthetic polypeptide
DEECISTTNPVATEGYGQCVCSNWGEDHNAENFNSDNQS

SEQ ID NO: 207361 - protein, 39 aa, Artificial Sequence
  Description of Artificial Sequence: Synthetic polypeptide
DEAEISTTNPVATEQYGQCVCGNWGEDHNTENFNSQTQA

SEQ ID NO: 207362 - protein, 36 aa, Artificial Sequence
  Description of Artificial Sequence: Synthetic polypeptide
TESEIATTNPVAYEQWGVYFTTMTIDHQTKDLKGKE

SEQ ID NO: 207363 - protein, 37 aa, Artificial Sequence
  Description of Artificial Sequence: Synthetic polypeptide
QEAEIATTNPVATAQWGSVVAYAGPPQDETPDGQMHQ

SEQ ID NO: 207364 - protein, 38 aa, Artificial Sequence
  Description of Artificial Sequence: Synthetic polypeptide
DENEISCTNPVATEGYGQCAVCSWEEHNAENFNSEFQS

SEQ ID NO: 207365 - protein, 35 aa, Artificial Sequence
  Description of Artificial Sequence: Synthetic polypeptide
DEQEIKTTNPIATECWGATTWANAEDWAEPKGPYI

SEQ ID NO: 207366 - protein, 37 aa, Artificial Sequence
  Description of Artificial Sequence: Synthetic polypeptide
AENEIATTNPVATEGYGCVCENWGEDDNQEHFISEQA

SEQ ID NO: 207367 - protein, 37 aa, Artificial Sequence
  Description of Artificial Sequence: Synthetic polypeptide
AENEIATTNPVATEGYGCQVCSWGEHNQEHFISETQA

SEQ ID NO: 207368 - protein, 38 aa, Artificial Sequence
  Description of Artificial Sequence: Synthetic polypeptide
MENEIRTTNPVATEQWGCVNDDNEEGEEMNAGTGDGAQ

SEQ ID NO: 207369 - protein, 39 aa, Artificial Sequence
  Description of Artificial Sequence: Synthetic polypeptide
DEECISTTNPVATEGYGQCVCSNWGEDHNAENFNSDTQA

SEQ ID NO: 207370 - protein, 38 aa, Artificial Sequence
  Description of Artificial Sequence: Synthetic polypeptide
DEAEISTTNPVATEQYGCTCSNWGEDDNAEYFISDTQS

SEQ ID NO: 207371 - protein, 39 aa, Artificial Sequence
  Description of Artificial Sequence: Synthetic polypeptide
DEAEISTTNPVATEQYGQCVCGNWGEPHNAENFNSETQA

SEQ ID NO: 207372 - protein, 38 aa, Artificial Sequence
  Description of Artificial Sequence: Synthetic polypeptide
DEVEIATTNPVAYEQWGSIICPAVAHAGGDHQGDNMEA

SEQ ID NO: 207373 - protein, 35 aa, Artificial Sequence
  Description of Artificial Sequence: Synthetic polypeptide
DENMIATTNPTAYEQWGATYYNIEIEMNQREMTEH

SEQ ID NO: 207374 - protein, 34 aa, Artificial Sequence
  Description of Artificial Sequence: Synthetic polypeptide
QESEIRTTNPIATECWGATTWAAEDWAEPKGPYI

SEQ ID NO: 207375 - protein, 39 aa, Artificial Sequence
  Description of Artificial Sequence: Synthetic polypeptide
DEAEISTTNPVATEGYGQCVCSNWMEDHNAENFNSENQA

SEQ ID NO: 207376 - protein, 35 aa, Artificial Sequence
  Description of Artificial Sequence: Synthetic polypeptide
DENMIATTNPTAYEQWGATYYNIEIEDDQREMDHD

SEQ ID NO: 207377 - protein, 39 aa, Artificial Sequence
  Description of Artificial Sequence: Synthetic polypeptide
DDAEIRTTNPVATEGYGQCVCSNWGEDHNAENFNSDTQS

SEQ ID NO: 207378 - protein, 38 aa, Artificial Sequence
  Description of Artificial Sequence: Synthetic polypeptide
DDAEIRTTNPVATEQYGCCCGNWGEDHNAEHFISDTQA

SEQ ID NO: 207379 - protein, 39 aa, Artificial Sequence
  Description of Artificial Sequence: Synthetic polypeptide
AEEEIRTTNPVAYEYYGQCVCSNWGEDHNAENFNSETQS

SEQ ID NO: 207380 - protein, 36 aa, Artificial Sequence
  Description of Artificial Sequence: Synthetic polypeptide
DEVEIATTNPVAYYAPQWGHSIAAAGEDGDSGNEEG

SEQ ID NO: 207381 - protein, 38 aa, Artificial Sequence
  Description of Artificial Sequence: Synthetic polypeptide
CEEEIACTNPVATEQYGSCDAAAGNAEGASDSGSGEDA

SEQ ID NO: 207382 - protein, 38 aa, Artificial Sequence
  Description of Artificial Sequence: Synthetic polypeptide
DENEISTTNPVATEGWGICVTSNWGEHNTENFISDTAS

SEQ ID NO: 207383 - protein, 40 aa, Artificial Sequence
  Description of Artificial Sequence: Synthetic polypeptide
AEEEISCTNPVATEQYGQCQVCSNWGEDHNTENFNSDNQA

SEQ ID NO: 207384 - protein, 35 aa, Artificial Sequence
  Description of Artificial Sequence: Synthetic polypeptide
DELEIATTNPIATECWGATYYANENDGHEKTGETH

SEQ ID NO: 207385 - protein, 39 aa, Artificial Sequence
  Description of Artificial Sequence: Synthetic polypeptide
AEEEISCTNPVATEQYGQCVCSNWGEDHNAENFNSDTQG

SEQ ID NO: 207386 - protein, 35 aa, Artificial Sequence
  Description of Artificial Sequence: Synthetic polypeptide
DENMIATTNPTAYEQWGATYYNIEGEMNQREMDHV

SEQ ID NO: 207387 - protein, 37 aa, Artificial Sequence
  Description of Artificial Sequence: Synthetic polypeptide
CEEEIACTNPVATEQYGSICAAAGEAEGADSGSDEDA

SEQ ID NO: 207388 - protein, 38 aa, Artificial Sequence
  Description of Artificial Sequence: Synthetic polypeptide
DEEEIATTNPVAYEQYGCQIPNPNSVGPCEASIIEQTS

SEQ ID NO: 207389 - protein, 36 aa, Artificial Sequence
  Description of Artificial Sequence: Synthetic polypeptide
DEAENATTNPCAYECWGCVAGGPNGNQQLEGDHQRT

SEQ ID NO: 207390 - protein, 39 aa, Artificial Sequence
  Description of Artificial Sequence: Synthetic polypeptide
ADEEISTTNPVATEQYGQCVCSNWGEDDNAENFNSDTQA

SEQ ID NO: 207391 - protein, 39 aa, Artificial Sequence
  Description of Artificial Sequence: Synthetic polypeptide
ADEEISTTNPVATEQYGQCVCSNWGEDHNAEGFQSETQA

SEQ ID NO: 207392 - protein, 39 aa, Artificial Sequence
  Description of Artificial Sequence: Synthetic polypeptide
ADEEISTTNPVATEQYGQCVCSNWGEDHNAEHFNSQTQL

SEQ ID NO: 207393 - protein, 39 aa, Artificial Sequence
  Description of Artificial Sequence: Synthetic polypeptide
SEEEISCTNPVATEQYGQCVCSNWGEDHNAENFNSDTQS

SEQ ID NO: 207394 - protein, 35 aa, Artificial Sequence
  Description of Artificial Sequence: Synthetic polypeptide
DENMIATTNPTAYEQWGATYYHIEIEMNQREMDNH

SEQ ID NO: 207395 - protein, 39 aa, Artificial Sequence
  Description of Artificial Sequence: Synthetic polypeptide
ADEEISTTNPVATEQYGQCVCSNWGEDHNAENFGSDTQS

SEQ ID NO: 207396 - protein, 37 aa, Artificial Sequence
  Description of Artificial Sequence: Synthetic polypeptide
DEFPICTTNPVAFEQWGSDNLSEQIQQTMNGMEEDAN

SEQ ID NO: 207397 - protein, 39 aa, Artificial Sequence
  Description of Artificial Sequence: Synthetic polypeptide
DEAEISTTNPVATEQYGQCVCGNWGEDHNAENFNSDTQS

SEQ ID NO: 207398 - protein, 39 aa, Artificial Sequence
  Description of Artificial Sequence: Synthetic polypeptide
DEECISTTNPVATEGYGQCVCSNWGEDHNAENFNSDTQI

SEQ ID NO: 207399 - protein, 35 aa, Artificial Sequence
  Description of Artificial Sequence: Synthetic polypeptide
DENEIRTTNPIAWECWGATTWANAEDWEENQIPYI

SEQ ID NO: 207400 - protein, 40 aa, Artificial Sequence
  Description of Artificial Sequence: Synthetic polypeptide
AEEEIRTTNPVAYEQYGQCAVCSNWGEDHNIENFNSDTQA

SEQ ID NO: 207401 - protein, 37 aa, Artificial Sequence
  Description of Artificial Sequence: Synthetic polypeptide
SEEEIRVTNPVAYEAWGTVCVTWEQDDARERAKDTED

SEQ ID NO: 207402 - protein, 35 aa, Artificial Sequence
  Description of Artificial Sequence: Synthetic polypeptide
DEFVIRTTNPIATECWGATTWANAEDWAEPKGPYI

SEQ ID NO: 207403 - protein, 38 aa, Artificial Sequence
  Description of Artificial Sequence: Synthetic polypeptide
DEVEIATTNPVATEQWGGCHIAGKPGETMPDEQMENNM

SEQ ID NO: 207404 - protein, 37 aa, Artificial Sequence
  Description of Artificial Sequence: Synthetic polypeptide
SEEEISCTNPCATEQYGCVCSNWGEDNAEHFISDTQS

SEQ ID NO: 207405 - protein, 38 aa, Artificial Sequence
  Description of Artificial Sequence: Synthetic polypeptide
CEMEISTTNPVAYEQYGQCVCSNWGEHNAENFISDNQS

SEQ ID NO: 207406 - protein, 39 aa, Artificial Sequence
  Description of Artificial Sequence: Synthetic polypeptide
CEEEISTTNPVAYEQYGQCVCSNWGEWHNQEYFNSDTQS

SEQ ID NO: 207407 - protein, 39 aa, Artificial Sequence
  Description of Artificial Sequence: Synthetic polypeptide
DEAEISTTNPVATEGYGQCVCSNWMEDHNAENFNSETQS

SEQ ID NO: 207408 - protein, 34 aa, Artificial Sequence
  Description of Artificial Sequence: Synthetic polypeptide
QECEIACTNPCSYEQWGITCYCNDQQDHGDTVRR

SEQ ID NO: 207409 - protein, 38 aa, Artificial Sequence
  Description of Artificial Sequence: Synthetic polypeptide
DENEIRTTNPVSTEGYGCICSNWEEGDNAENFISDNQS

SEQ ID NO: 207410 - protein, 39 aa, Artificial Sequence
  Description of Artificial Sequence: Synthetic polypeptide
DEMEIATTNPVATEGYGQCVCSNWGEDDNAEHFNSENQA

SEQ ID NO: 207411 - protein, 35 aa, Artificial Sequence
  Description of Artificial Sequence: Synthetic polypeptide
DETEIATTNPTATECWGATYYANENDGHEKTGKTH

SEQ ID NO: 207412 - protein, 38 aa, Artificial Sequence
  Description of Artificial Sequence: Synthetic polypeptide
SEEEISCTNPCATEQYGQCVCSNWMEDNAENFGSDTQS

SEQ ID NO: 207413 - protein, 38 aa, Artificial Sequence
  Description of Artificial Sequence: Synthetic polypeptide
DESEIRTTNPMAYEAWGISHVPVNANSSSDREGGMEVC

SEQ ID NO: 207414 - protein, 36 aa, Artificial Sequence
  Description of Artificial Sequence: Synthetic polypeptide
QEEEIATTNPVAYESYGEHAPWCEHEVSIHAEGEGQ

SEQ ID NO: 207415 - protein, 37 aa, Artificial Sequence
  Description of Artificial Sequence: Synthetic polypeptide
DESEIRTTNPMAYEAWGICVPVNANSSSDREGGMDVC

SEQ ID NO: 207416 - protein, 35 aa, Artificial Sequence
  Description of Artificial Sequence: Synthetic polypeptide
DENMIATTNPTAYEQWGATYYNIEIEMNQREMDKD

SEQ ID NO: 207417 - protein, 36 aa, Artificial Sequence
  Description of Artificial Sequence: Synthetic polypeptide
CEEVIACTNPVATEQWGCVANMNNHSNAAGGPGEQT

SEQ ID NO: 207418 - protein, 34 aa, Artificial Sequence
  Description of Artificial Sequence: Synthetic polypeptide
DETEIATTNPICTECWGVTVWAAEDWAESKGPYI

SEQ ID NO: 207419 - protein, 35 aa, Artificial Sequence
  Description of Artificial Sequence: Synthetic polypeptide
DESEIRTTNPIGTECWGATTWANAEDWAEPKGPYI

SEQ ID NO: 207420 - protein, 37 aa, Artificial Sequence
  Description of Artificial Sequence: Synthetic polypeptide
DDAEIATTNPVATCGYGCVCSNWGAHNAENFGSDTQS

SEQ ID NO: 207421 - protein, 35 aa, Artificial Sequence
  Description of Artificial Sequence: Synthetic polypeptide
DENMIATTNPTAYEQWGATYYNIEIEMHQREMDEG

SEQ ID NO: 207422 - protein, 38 aa, Artificial Sequence
  Description of Artificial Sequence: Synthetic polypeptide
DEMEISTTNPVAYEGYGICVCSNWGEPNAENFNSDTQA

SEQ ID NO: 207423 - protein, 39 aa, Artificial Sequence
  Description of Artificial Sequence: Synthetic polypeptide
AEEEISTTNPVATEGYGQCVCSNWGEDDNAENFNSDNQS

SEQ ID NO: 207424 - protein, 38 aa, Artificial Sequence
  Description of Artificial Sequence: Synthetic polypeptide
DEMEIRTTNPVAYCGYGQCVCSNWGEHNEEYFNSDTQS

SEQ ID NO: 207425 - protein, 38 aa, Artificial Sequence
  Description of Artificial Sequence: Synthetic polypeptide
ADECISTTNPVATEQYGCVCSNWGEDHNAENFNSDFQA

SEQ ID NO: 207426 - protein, 39 aa, Artificial Sequence
  Description of Artificial Sequence: Synthetic polypeptide
DEACISTTNPVATEQYGQCVCSNWGEDHNIENFNSDTQG

SEQ ID NO: 207427 - protein, 36 aa, Artificial Sequence
  Description of Artificial Sequence: Synthetic polypeptide
NEDEIACTNPVAYEQWGCVTAANPGNLTAAPDGAPH

SEQ ID NO: 207428 - protein, 39 aa, Artificial Sequence
  Description of Artificial Sequence: Synthetic polypeptide
DEACISTTNPVATEQYGQCVCSNWGEDHNIENFNSDPQA

SEQ ID NO: 207429 - protein, 35 aa, Artificial Sequence
  Description of Artificial Sequence: Synthetic polypeptide
DETEIATTNPCATECWGATTWANAEDWAEPKGPYI

SEQ ID NO: 207430 - protein, 38 aa, Artificial Sequence
  Description of Artificial Sequence: Synthetic polypeptide
DEEEIATTNPVAYAQWGGCTIPAGNNGDTTANQGGDNQ

SEQ ID NO: 207431 - protein, 40 aa, Artificial Sequence
  Description of Artificial Sequence: Synthetic polypeptide
DEEEISTTNPVAYEAYGQCAVCSNWGEDHNTENFNSDNQS

SEQ ID NO: 207432 - protein, 39 aa, Artificial Sequence
  Description of Artificial Sequence: Synthetic polypeptide
DENEISTTNPVATEGYGQCVCSNWGEDHNAENFNSDTAS

SEQ ID NO: 207433 - protein, 39 aa, Artificial Sequence
  Description of Artificial Sequence: Synthetic polypeptide
DENEISTTNPVATEGYGQCVCSNWGEDHNAENFSSENQS

SEQ ID NO: 207434 - protein, 38 aa, Artificial Sequence
  Description of Artificial Sequence: Synthetic polypeptide
ADECISTTNPVATEQYGCVCSNWGEDHNAENFNSDTQP

SEQ ID NO: 207435 - protein, 39 aa, Artificial Sequence
  Description of Artificial Sequence: Synthetic polypeptide
DENEISTTNPVATEGYGQCVCSNWGEDHNEEYFNSDTQP

SEQ ID NO: 207436 - protein, 39 aa, Artificial Sequence
  Description of Artificial Sequence: Synthetic polypeptide
DENEISTTNPVATEGYGQCVCSNWGEDHNQENFGSDPQS

SEQ ID NO: 207437 - protein, 34 aa, Artificial Sequence
  Description of Artificial Sequence: Synthetic polypeptide
DETEIASTNPISTECWGNTVWAAATIQEPVGQYI

SEQ ID NO: 207438 - protein, 40 aa, Artificial Sequence
  Description of Artificial Sequence: Synthetic polypeptide
CEEEISTTNPVAYEQYGQCIVCSNWGEDTNAENFNSDTQI

SEQ ID NO: 207439 - protein, 34 aa, Artificial Sequence
  Description of Artificial Sequence: Synthetic polypeptide
DETEIASTNPISTECWGNTVWAAATIAEPVGQYI

SEQ ID NO: 207440 - protein, 35 aa, Artificial Sequence
  Description of Artificial Sequence: Synthetic polypeptide
DESEIRTTNPIATECWGATTWAPAEDWAEPKGPYP

SEQ ID NO: 207441 - protein, 36 aa, Artificial Sequence
  Description of Artificial Sequence: Synthetic polypeptide
DESEIRTTNPIATECWGATTWANCEDWAEPKGEPYI

SEQ ID NO: 207442 - protein, 39 aa, Artificial Sequence
  Description of Artificial Sequence: Synthetic polypeptide
DEEEISTTNPVAYEEYGQCVCSNWEEDHNAENFNSDTQA

SEQ ID NO: 207443 - protein, 39 aa, Artificial Sequence
  Description of Artificial Sequence: Synthetic polypeptide
DEEEISTTNPVAYEEYGQCVCSNWGEDDNAEGFNSENQA

SEQ ID NO: 207444 - protein, 33 aa, Artificial Sequence
  Description of Artificial Sequence: Synthetic polypeptide
VEGEIACTNPCSYEQWGITCYCNDQQDHGQTDG

SEQ ID NO: 207445 - protein, 39 aa, Artificial Sequence
  Description of Artificial Sequence: Synthetic polypeptide
DEEEISTTNPVAYEAYGQCVCSNWEELHNAENFNSDNQS

SEQ ID NO: 207446 - protein, 39 aa, Artificial Sequence
  Description of Artificial Sequence: Synthetic polypeptide
DENEISTTNPVATEGYGQCVCSNWGEDHNAEHFNSDTQS

SEQ ID NO: 207447 - protein, 38 aa, Artificial Sequence
  Description of Artificial Sequence: Synthetic polypeptide
DEACISCTNPVATEQYGQCVCSNWGEDNAENFNSDTQS

SEQ ID NO: 207448 - protein, 39 aa, Artificial Sequence
  Description of Artificial Sequence: Synthetic polypeptide
AEEAISTTNPVATEQYGQCVCSNWGEDHNAEYFNSETQS

SEQ ID NO: 207449 - protein, 39 aa, Artificial Sequence
  Description of Artificial Sequence: Synthetic polypeptide
DEACISTTNPVATEQYGQCVCSNWGEDHNTESFNSDTQA

SEQ ID NO: 207450 - protein, 39 aa, Artificial Sequence
  Description of Artificial Sequence: Synthetic polypeptide
DEEAISTTNPVATEGYGQCVCSNWGEDHNAENFNSETQS

SEQ ID NO: 207451 - protein, 39 aa, Artificial Sequence
  Description of Artificial Sequence: Synthetic polypeptide
AEEEISTTNPVATEGYGQCVCSNWGEDHNAEGFNSDNQA

SEQ ID NO: 207452 - protein, 39 aa, Artificial Sequence
  Description of Artificial Sequence: Synthetic polypeptide
DEAEISTTNPVATEQYGQCAVCSNWGEHNAENFISDTQS

SEQ ID NO: 207453 - protein, 38 aa, Artificial Sequence
  Description of Artificial Sequence: Synthetic polypeptide
DEACISCTNPVATEQYGCVCENWGEDPNQEYFGSDTQS

SEQ ID NO: 207454 - protein, 38 aa, Artificial Sequence
  Description of Artificial Sequence: Synthetic polypeptide
DEMVIGTTNPVATEQWGQCVCSNWGEDHNQEYFGSDQA

SEQ ID NO: 207455 - protein, 36 aa, Artificial Sequence
  Description of Artificial Sequence: Synthetic polypeptide
CEDVIACTNPVATAQWGGCVAAANNLQEAPGGQQHH

SEQ ID NO: 207456 - protein, 37 aa, Artificial Sequence
  Description of Artificial Sequence: Synthetic polypeptide
DEEEIATTNPVAYAQWGPNACAAANGDAMQAANDQHQ

SEQ ID NO: 207457 - protein, 39 aa, Artificial Sequence
  Description of Artificial Sequence: Synthetic polypeptide
SEEEISTTNPVATEGYGQCVCSNSEEDDNQENFNSDNQS

SEQ ID NO: 207458 - protein, 39 aa, Artificial Sequence
  Description of Artificial Sequence: Synthetic polypeptide
SEEEISTTNPVATEGYGQCVCSNWGEDHNDEFFGSDTQS

SEQ ID NO: 207459 - protein, 39 aa, Artificial Sequence
  Description of Artificial Sequence: Synthetic polypeptide
AEEAISTTNPVATEQYGQCVCSNWGEDHNAENFNSDNQL

SEQ ID NO: 207460 - protein, 39 aa, Artificial Sequence
  Description of Artificial Sequence: Synthetic polypeptide
DEACISTTNPVATEQYGQCVCSNWGEDHNTEHFNSETQS

SEQ ID NO: 207461 - protein, 39 aa, Artificial Sequence
  Description of Artificial Sequence: Synthetic polypeptide
DEECISTTNPVATEGYGQCVCSNWGEDHNAEHFNSETQS

SEQ ID NO: 207462 - protein, 38 aa, Artificial Sequence
  Description of Artificial Sequence: Synthetic polypeptide
DEEEIACTNPVATEQWGCTVIFAGNGMHGPDDSGEGAQ

SEQ ID NO: 207463 - protein, 39 aa, Artificial Sequence
  Description of Artificial Sequence: Synthetic polypeptide
DEACISTTNPVATEQYGQCVCSNWGEDHNTEHFNSDTQS

SEQ ID NO: 207464 - protein, 39 aa, Artificial Sequence
  Description of Artificial Sequence: Synthetic polypeptide
DEEAISTTNPVATEGYGQCVCSNWGEDHNAENFNSDTQP

SEQ ID NO: 207465 - protein, 39 aa, Artificial Sequence
  Description of Artificial Sequence: Synthetic polypeptide
AEEAISTTNPVATEQYGQCVCSNWGEDHNAENFNSDTQS

SEQ ID NO: 207466 - protein, 39 aa, Artificial Sequence
  Description of Artificial Sequence: Synthetic polypeptide
DEEAISTTNPVATEGYGQCVCSNWGEDHNAENFNSDTQA

SEQ ID NO: 207467 - protein, 39 aa, Artificial Sequence
  Description of Artificial Sequence: Synthetic polypeptide
SEEEISTTNPVATEGYGQCVCSNWGEDHNTENFNSDTQA

SEQ ID NO: 207468 - protein, 39 aa, Artificial Sequence
  Description of Artificial Sequence: Synthetic polypeptide
DEACISTTNPVATEQYGQCVCSNWGEDHNQEYFNSDFQS

SEQ ID NO: 207469 - protein, 39 aa, Artificial Sequence
  Description of Artificial Sequence: Synthetic polypeptide
SEEEISTTNPVATEGYGQCVCSNWGEGHNAENFNSDNQL

SEQ ID NO: 207470 - protein, 39 aa, Artificial Sequence
  Description of Artificial Sequence: Synthetic polypeptide
DEACISTTNPVATEQYGQCVCSNWGEDHNIEGFISDNQP

SEQ ID NO: 207471 - protein, 39 aa, Artificial Sequence
  Description of Artificial Sequence: Synthetic polypeptide
DEEEISTTNPVAYEEYGQCVCSNWGEDHNEENFGSDTQA

SEQ ID NO: 207472 - protein, 39 aa, Artificial Sequence
  Description of Artificial Sequence: Synthetic polypeptide
AEEEIRTTNPVAYEAYGQCVCSNWGEDHNAENFNSENQS

SEQ ID NO: 207473 - protein, 38 aa, Artificial Sequence
  Description of Artificial Sequence: Synthetic polypeptide
DEEEISTTNPVAYEGYGCVCGNWEEDHNAENFNSDNQG

SEQ ID NO: 207474 - protein, 39 aa, Artificial Sequence
  Description of Artificial Sequence: Synthetic polypeptide
DEECISTTNPVATEGYGQCVCSNWGEDHNAEGFNSETQA

SEQ ID NO: 207475 - protein, 39 aa, Artificial Sequence
  Description of Artificial Sequence: Synthetic polypeptide
DEEEISTTNPVAYEGYGICVCSNWVEDDNAENFISDNQA

SEQ ID NO: 207476 - protein, 39 aa, Artificial Sequence
  Description of Artificial Sequence: Synthetic polypeptide
DDAEIRTTNPVAYEQYGQCVCSNWGEDHNAENFNSDNQA

SEQ ID NO: 207477 - protein, 38 aa, Artificial Sequence
  Description of Artificial Sequence: Synthetic polypeptide
DEECISTTNPVAYEGYGCVCSNWGEDHNAENFNSDFQS

SEQ ID NO: 207478 - protein, 38 aa, Artificial Sequence
  Description of Artificial Sequence: Synthetic polypeptide
QESEIKTTNPAATEAYGVVVVSTGTNAGMEEGGEFGQG

SEQ ID NO: 207479 - protein, 34 aa, Artificial Sequence
  Description of Artificial Sequence: Synthetic polypeptide
TESEIASTNPVGTEAWGVCAPTDRDQHQGQHDQE

SEQ ID NO: 207480 - protein, 39 aa, Artificial Sequence
  Description of Artificial Sequence: Synthetic polypeptide
DEACISTTNPVATEQYGQCVCSNWGEDHNAENFNSDTQA

SEQ ID NO: 207481 - protein, 34 aa, Artificial Sequence
  Description of Artificial Sequence: Synthetic polypeptide
TESEIASTNPVGTEAWGVCAPTDRDQHNGKDDMT

SEQ ID NO: 207482 - protein, 39 aa, Artificial Sequence
  Description of Artificial Sequence: Synthetic polypeptide
DEACISTTNPVATEQYGQCVCSNWGEDHNAEHFNSDNQS

SEQ ID NO: 207483 - protein, 39 aa, Artificial Sequence
  Description of Artificial Sequence: Synthetic polypeptide
DDAEIRTTNPVAYEQYGQCVCSNWGEDHNAENFNSETQS

SEQ ID NO: 207484 - protein, 39 aa, Artificial Sequence
  Description of Artificial Sequence: Synthetic polypeptide
DEACISTTNPVATEQYGQCVCSNWGEDHNAEFFNSDTQS

SEQ ID NO: 207485 - protein, 38 aa, Artificial Sequence
  Description of Artificial Sequence: Synthetic polypeptide
DEEAISTTNPVATEGYGQCVCGNWGEHNAENFNSDTQS

SEQ ID NO: 207486 - protein, 40 aa, Artificial Sequence
  Description of Artificial Sequence: Synthetic polypeptide
DEEEISTTNPVAYEGYGQCAVCSTWGEDHNAENFNSDTQA

SEQ ID NO: 207487 - protein, 40 aa, Artificial Sequence
  Description of Artificial Sequence: Synthetic polypeptide
DEVEAEISCTSCTNPVAYECWGSVSGGNDIDDRQGQGGDA

SEQ ID NO: 207488 - protein, 39 aa, Artificial Sequence
  Description of Artificial Sequence: Synthetic polypeptide
MESCIRTTNPVATEQYGLANCYSATNFDIGDFDTFEEVA

SEQ ID NO: 207489 - protein, 39 aa, Artificial Sequence
  Description of Artificial Sequence: Synthetic polypeptide
DEACISTTNPVATEQYGQCVCSMWGEDHNAEYFNSETQS

SEQ ID NO: 207490 - protein, 36 aa, Artificial Sequence
  Description of Artificial Sequence: Synthetic polypeptide
QEEEIATTNPVAYEQYGEHAPWCWHEFSIHAEGEIQ

SEQ ID NO: 207491 - protein, 38 aa, Artificial Sequence
  Description of Artificial Sequence: Synthetic polypeptide
QEGEIATTNPVATEQWGCVVATGGHQLDEATPDDNKHM

SEQ ID NO: 207492 - protein, 39 aa, Artificial Sequence
  Description of Artificial Sequence: Synthetic polypeptide
DEEEISTTNPVAYEGYGQCQVCSWGEDHNAENFNSDNQS

SEQ ID NO: 207493 - protein, 36 aa, Artificial Sequence
  Description of Artificial Sequence: Synthetic polypeptide
DEVAIGTTNPVATEQYGCLRHATDGSPVEFETSDKQ

SEQ ID NO: 207494 - protein, 39 aa, Artificial Sequence
  Description of Artificial Sequence: Synthetic polypeptide
DEEEISTTNPVAYEGYGQCVCFTWGEDHNIENFNSENQS

SEQ ID NO: 207495 - protein, 38 aa, Artificial Sequence
  Description of Artificial Sequence: Synthetic polypeptide
DENEISTTNPVATEQWGCVCSNSGPAENAENFSSDTAS

SEQ ID NO: 207496 - protein, 39 aa, Artificial Sequence
  Description of Artificial Sequence: Synthetic polypeptide
AEEAISTTNPVATEQYGQCVCSNSGEDDNAENFNSDTQS

SEQ ID NO: 207497 - protein, 39 aa, Artificial Sequence
  Description of Artificial Sequence: Synthetic polypeptide
DEMEISTTNPVATEAYGQCVCSNWGEDPNAENFGSDTQA

SEQ ID NO: 207498 - protein, 39 aa, Artificial Sequence
  Description of Artificial Sequence: Synthetic polypeptide
AEEEISTTNPVATEQYGQCVCSNWGEDHNAEFFISDTQS

SEQ ID NO: 207499 - protein, 39 aa, Artificial Sequence
  Description of Artificial Sequence: Synthetic polypeptide
DEACISTTNPVATEQYGQCVCSNWGEDHNAEYFNSENQA

SEQ ID NO: 207500 - protein, 38 aa, Artificial Sequence
  Description of Artificial Sequence: Synthetic polypeptide
DEEEISTTNPVAYEGYGCVCGNWEEDHNAENFNSDTQS

SEQ ID NO: 207501 - protein, 36 aa, Artificial Sequence
  Description of Artificial Sequence: Synthetic polypeptide
AENEIATTNPVAYEGYGCVCSWGEHNIEHFISETLA

SEQ ID NO: 207502 - protein, 38 aa, Artificial Sequence
  Description of Artificial Sequence: Synthetic polypeptide
DEEEISTTNPVAYEGYGCVCGNWGEDHNAENFNSDTQS

SEQ ID NO: 207503 - protein, 38 aa, Artificial Sequence
  Description of Artificial Sequence: Synthetic polypeptide
DEEEISTTNPVAYEGYGCVCGNWGEDHNIENFNSDTQS

SEQ ID NO: 207504 - protein, 39 aa, Artificial Sequence
  Description of Artificial Sequence: Synthetic polypeptide
DDAEIRTTNPVAYEGYGQCVCSNWGEDHNQEGFNSETQS

SEQ ID NO: 207505 - protein, 39 aa, Artificial Sequence
  Description of Artificial Sequence: Synthetic polypeptide
DEACISTTNPVATEQYGQCVCSNWGEDHNAENSNSDTQS

SEQ ID NO: 207506 - protein, 39 aa, Artificial Sequence
  Description of Artificial Sequence: Synthetic polypeptide
DEACISTTNPVATEQYGQCVCSNWGEDHNAENFNSETQA

SEQ ID NO: 207507 - protein, 36 aa, Artificial Sequence
  Description of Artificial Sequence: Synthetic polypeptide
DESQIGTTNPVATEQYGELCTATDGSPVEFETSDKQ

SEQ ID NO: 207508 - protein, 39 aa, Artificial Sequence
  Description of Artificial Sequence: Synthetic polypeptide
DEEAISTTNPVATEGYGQCVCSNWGEDHNAENFISENQA

SEQ ID NO: 207509 - protein, 38 aa, Artificial Sequence
  Description of Artificial Sequence: Synthetic polypeptide
DEEEISTTNPVAYEGYGCVCQNWGEDHNAENFNSENQS

SEQ ID NO: 207510 - protein, 34 aa, Artificial Sequence
  Description of Artificial Sequence: Synthetic polypeptide
DETEIAPTNPIATECWGATVWAAEDWAEPKGPYI

SEQ ID NO: 207511 - protein, 34 aa, Artificial Sequence
  Description of Artificial Sequence: Synthetic polypeptide
TESEIASTNPVGTEAWGVCAYTDRDQHQGQMEQE

SEQ ID NO: 207512 - protein, 34 aa, Artificial Sequence
  Description of Artificial Sequence: Synthetic polypeptide
TESEIASTNPVGTEAWGVCAPTERDQHQGQQQQD

SEQ ID NO: 207513 - protein, 39 aa, Artificial Sequence
  Description of Artificial Sequence: Synthetic polypeptide
DEACISTTNPVATEQYGQCVCSNWGEDHNAENFNSDTQS

SEQ ID NO: 207514 - protein, 34 aa, Artificial Sequence
  Description of Artificial Sequence: Synthetic polypeptide
TESEIASTNPVGTEAWGVCAPTDRDQHQQQHPNH

SEQ ID NO: 207515 - protein, 39 aa, Artificial Sequence
  Description of Artificial Sequence: Synthetic polypeptide
DEACISTTNPVATEQYGQCVCSNWGEDHNAENFNSDTQF

SEQ ID NO: 207516 - protein, 39 aa, Artificial Sequence
  Description of Artificial Sequence: Synthetic polypeptide
DEEAISTTNPVATEGYGQCVCSNWGEDHNAENFGSETQS

SEQ ID NO: 207517 - protein, 34 aa, Artificial Sequence
  Description of Artificial Sequence: Synthetic polypeptide
TESEIASTNPVGTEAWGVCAPTDRDQHQGQTQTD

SEQ ID NO: 207518 - protein, 34 aa, Artificial Sequence
  Description of Artificial Sequence: Synthetic polypeptide
TESEIASTNPVGTEAWGVCAPTDRDQHQGQQQMM

SEQ ID NO: 207519 - protein, 35 aa, Artificial Sequence
  Description of Artificial Sequence: Synthetic polypeptide
VSSEVASTNPVSYEGYGNVVACNTISQSLVGGSNR

SEQ ID NO: 207520 - protein, 38 aa, Artificial Sequence
  Description of Artificial Sequence: Synthetic polypeptide
DENEISTTNPVATEQWGCVCSNSGEDENAENFSSDTAA

SEQ ID NO: 207521 - protein, 38 aa, Artificial Sequence
  Description of Artificial Sequence: Synthetic polypeptide
DEMEISCTNPVAYEQYGCVCSNWGEDPNAEFFNSDTQA

SEQ ID NO: 207522 - protein, 39 aa, Artificial Sequence
  Description of Artificial Sequence: Synthetic polypeptide
DEEGETEIATTNPCAYECWGTVCSTWINDDQGIDQDNHS

SEQ ID NO: 207523 - protein, 39 aa, Artificial Sequence
  Description of Artificial Sequence: Synthetic polypeptide
DEEAISTTNPVATEGYGQCVCSNWGEDHNAEYFNSETQS

SEQ ID NO: 207524 - protein, 39 aa, Artificial Sequence
  Description of Artificial Sequence: Synthetic polypeptide
AEEEISTTNPVATEGYGQCVCSNWGEDHNAENSNSDTQS

SEQ ID NO: 207525 - protein, 39 aa, Artificial Sequence
  Description of Artificial Sequence: Synthetic polypeptide
AEEEISTTNPVATEGYGQCVCSNWGEDHNAESFNSDTQA

SEQ ID NO: 207526 - protein, 38 aa, Artificial Sequence
  Description of Artificial Sequence: Synthetic polypeptide
DEAAIRTTNPVATEQWGQCVCGWNEDDNAEHFGSDTQA

SEQ ID NO: 207527 - protein, 35 aa, Artificial Sequence
  Description of Artificial Sequence: Synthetic polypeptide
DETEIATTNPIATECWGATTWANAEDWAEPKGPYI

SEQ ID NO: 207528 - protein, 38 aa, Artificial Sequence
  Description of Artificial Sequence: Synthetic polypeptide
DEAAIRTTNPVATEGYGSSCPLAIVTGAAETQVFQEMP

SEQ ID NO: 207529 - protein, 35 aa, Artificial Sequence
  Description of Artificial Sequence: Synthetic polypeptide
DETEIATTNPIATECWGATTWANAEDWAEPFGPYI

SEQ ID NO: 207530 - protein, 39 aa, Artificial Sequence
  Description of Artificial Sequence: Synthetic polypeptide
AEEEISTTNPVATEGYGQCVCSNWGEDHNAESFNSENQP

SEQ ID NO: 207531 - protein, 38 aa, Artificial Sequence
  Description of Artificial Sequence: Synthetic polypeptide
DEEEIRTTNPCAYEGYGQCCCSNWGEHNAENFNSDTQA

SEQ ID NO: 207532 - protein, 35 aa, Artificial Sequence
  Description of Artificial Sequence: Synthetic polypeptide
DETEIATTNPIATECWGATTWANAEAWAEPKGPYI

SEQ ID NO: 207533 - protein, 38 aa, Artificial Sequence
  Description of Artificial Sequence: Synthetic polypeptide
DEGEIATTNPVAYYYEPQWGCSATANGTGPRDQTEGEH

SEQ ID NO: 207534 - protein, 40 aa, Artificial Sequence
  Description of Artificial Sequence: Synthetic polypeptide
DEEEIACTNPVATEQWGCNVNATAGTGQLGGAEGGDINED

SEQ ID NO: 207535 - protein, 39 aa, Artificial Sequence
  Description of Artificial Sequence: Synthetic polypeptide
AEEEISTTNPVATEGYGQCVCSNWGEDHNAEYFMSDNQS

SEQ ID NO: 207536 - protein, 39 aa, Artificial Sequence
  Description of Artificial Sequence: Synthetic polypeptide
DEEAISTTNPVATEGYGQCVCSNWMEDHNAENFNSETQA

SEQ ID NO: 207537 - protein, 37 aa, Artificial Sequence
  Description of Artificial Sequence: Synthetic polypeptide
AENEIACTNPVATEQYGQCSCSWGEDNTEYFISDTQS

SEQ ID NO: 207538 - protein, 39 aa, Artificial Sequence
  Description of Artificial Sequence: Synthetic polypeptide
CEMEISTTNPVATEQYGQCVCSNWGEDHNIEHFNSDTQS

SEQ ID NO: 207539 - protein, 39 aa, Artificial Sequence
  Description of Artificial Sequence: Synthetic polypeptide
AENEIACTNPVATEQYGQCSCSNWMEADNAEYFGSDNQA

SEQ ID NO: 207540 - protein, 38 aa, Artificial Sequence
  Description of Artificial Sequence: Synthetic polypeptide
AENEIACTNPVATEQYGQCSCSNWGEDNAEYFNSDTQA

SEQ ID NO: 207541 - protein, 37 aa, Artificial Sequence
  Description of Artificial Sequence: Synthetic polypeptide
DETEIATTNPIATECWGATTTANATDGPAEPKGPQNP

SEQ ID NO: 207542 - protein, 38 aa, Artificial Sequence
  Description of Artificial Sequence: Synthetic polypeptide
DEEEISTTNPEATEGYGQCVCPNWGEDNAENFISDTQS

SEQ ID NO: 207543 - protein, 38 aa, Artificial Sequence
  Description of Artificial Sequence: Synthetic polypeptide
AENEIACTNPVATEQYGQCSCSNWGEDNAEYFISDNQS

SEQ ID NO: 207544 - protein, 39 aa, Artificial Sequence
  Description of Artificial Sequence: Synthetic polypeptide
SEEEISTTNPVATEGYGQCVCFNWGEDHNTENFGSDNQS

SEQ ID NO: 207545 - protein, 39 aa, Artificial Sequence
  Description of Artificial Sequence: Synthetic polypeptide
AEEEISTTNPVATEGYGQCVCSNWGEDHNAENFNSDTQS

SEQ ID NO: 207546 - protein, 37 aa, Artificial Sequence
  Description of Artificial Sequence: Synthetic polypeptide
DETEIATTNPIATECWGATTTANATDGPAEPAGNPYN

SEQ ID NO: 207547 - protein, 34 aa, Artificial Sequence
  Description of Artificial Sequence: Synthetic polypeptide
QEGEIACTNPCSYEQWGITCYCNDQQNEGDTVRE

SEQ ID NO: 207548 - protein, 39 aa, Artificial Sequence
  Description of Artificial Sequence: Synthetic polypeptide
DEMEIRTTNPVAYEGYGQCVTSTWGADHNAENFSSDPQA

SEQ ID NO: 207549 - protein, 36 aa, Artificial Sequence
  Description of Artificial Sequence: Synthetic polypeptide
DETEIATTNPIATECWGATTWAVATDGPAEPKGPIK

SEQ ID NO: 207550 - protein, 39 aa, Artificial Sequence
  Description of Artificial Sequence: Synthetic polypeptide
AEEEISTTNPVATEGYGQCVCSNWGEDHNAENFGSETQA

SEQ ID NO: 207551 - protein, 39 aa, Artificial Sequence
  Description of Artificial Sequence: Synthetic polypeptide
AEEEISTTNPVATEGYGQCVCSNWGEDHNAENFISDNQD

SEQ ID NO: 207552 - protein, 39 aa, Artificial Sequence
  Description of Artificial Sequence: Synthetic polypeptide
AEEEISTTNPVATEQYGQCVCSNWGEDHNAENFISDTQN

SEQ ID NO: 207553 - protein, 37 aa, Artificial Sequence
  Description of Artificial Sequence: Synthetic polypeptide
DEEEIATTNPVAYAQWGTSIACAAANGDAMQGADQHQ

SEQ ID NO: 207554 - protein, 38 aa, Artificial Sequence
  Description of Artificial Sequence: Synthetic polypeptide
DEMEIRTTNPVAYEGWGCVCSNWGEDENQEYFNSDTQA

SEQ ID NO: 207555 - protein, 35 aa, Artificial Sequence
  Description of Artificial Sequence: Synthetic polypeptide
DETEIATTNPIATECWGATTWANQEDWAEPKGPYI

SEQ ID NO: 207556 - protein, 39 aa, Artificial Sequence
  Description of Artificial Sequence: Synthetic polypeptide
AEEEISTTNPVATEGYGQCVCSNWGEDHNAENFNSDNQA

SEQ ID NO: 207557 - protein, 35 aa, Artificial Sequence
  Description of Artificial Sequence: Synthetic polypeptide
DETEIATTNPIATECWGATTWANNEDWAEPKGPYI

SEQ ID NO: 207558 - protein, 38 aa, Artificial Sequence
  Description of Artificial Sequence: Synthetic polypeptide
DEEEIACTNPVATEQWGCNATANGNGEITGAPDGSDHN

SEQ ID NO: 207559 - protein, 35 aa, Artificial Sequence
  Description of Artificial Sequence: Synthetic polypeptide
DETEIATTNPIATECWGATTWANEEDWAEPKGPYI

SEQ ID NO: 207560 - protein, 40 aa, Artificial Sequence
  Description of Artificial Sequence: Synthetic polypeptide
DEEEIRTTNPVATEQWGQCQVCSYWGEAHNAEYFISDTQA

SEQ ID NO: 207561 - protein, 36 aa, Artificial Sequence
  Description of Artificial Sequence: Synthetic polypeptide
DETEIATTNPIATECWGATTWANATDGWAQPKGPYN

SEQ ID NO: 207562 - protein, 36 aa, Artificial Sequence
  Description of Artificial Sequence: Synthetic polypeptide
DETEIATTNPIATECWGATTWANATDGPAQPAGPQN

SEQ ID NO: 207563 - protein, 34 aa, Artificial Sequence
  Description of Artificial Sequence: Synthetic polypeptide
QEGEIACTNPCSYEQWGITCYCNDSQQDHGDTDR

SEQ ID NO: 207564 - protein, 38 aa, Artificial Sequence
  Description of Artificial Sequence: Synthetic polypeptide
DEEHIATTNPVAYEQYGCTIPNPNVGPECEASINEQTS

SEQ ID NO: 207565 - protein, 36 aa, Artificial Sequence
  Description of Artificial Sequence: Synthetic polypeptide
NEEAEIASTNPVAYEQWGSVVCGVAQLDHVDTSTDH

SEQ ID NO: 207566 - protein, 36 aa, Artificial Sequence
  Description of Artificial Sequence: Synthetic polypeptide
DETEIATTNPIATECWGATTWANATDGPAIPNGPYN

SEQ ID NO: 207567 - protein, 39 aa, Artificial Sequence
  Description of Artificial Sequence: Synthetic polypeptide
DEAEISTTNPVATEQYGQCVCPNWGEDHNAENFISETQS

SEQ ID NO: 207568 - protein, 38 aa, Artificial Sequence
  Description of Artificial Sequence: Synthetic polypeptide
DEMEIRTTNPVAYEGWGQCVCSNWGEENAEYFGSDTQA

SEQ ID NO: 207569 - protein, 35 aa, Artificial Sequence
  Description of Artificial Sequence: Synthetic polypeptide
DETEIATTNPIATECWGATTWANAETWAEPKGPYI

SEQ ID NO: 207570 - protein, 39 aa, Artificial Sequence
  Description of Artificial Sequence: Synthetic polypeptide
AEEEISTTNPVATEGYGQCVCSNWGEDHNAENFNSDTQA

SEQ ID NO: 207571 - protein, 38 aa, Artificial Sequence
  Description of Artificial Sequence: Synthetic polypeptide
DDMEISTTNPVAYEQYGQCVCSWGEDDNAENFNSETQA

SEQ ID NO: 207572 - protein, 39 aa, Artificial Sequence
  Description of Artificial Sequence: Synthetic polypeptide
DDMEISTTNPVAYEQYGQCVCSNWEEDTNAENFNSDTQQ

SEQ ID NO: 207573 - protein, 35 aa, Artificial Sequence
  Description of Artificial Sequence: Synthetic polypeptide
QEEEIATTNPVAYEWYGEHAPWCEHEFSDHAEGDW

SEQ ID NO: 207574 - protein, 34 aa, Artificial Sequence
  Description of Artificial Sequence: Synthetic polypeptide
QEGEIACTNPCSYEQWGITCYCNEDQQDTGDTSR

SEQ ID NO: 207575 - protein, 35 aa, Artificial Sequence
  Description of Artificial Sequence: Synthetic polypeptide
TESEIASTNPVGTEGWGVCAPTDNQQNHQGQDGIE

SEQ ID NO: 207576 - protein, 36 aa, Artificial Sequence
  Description of Artificial Sequence: Synthetic polypeptide
DETEIATTNPIATECWGATFTANATDGPAEPKGPYN

SEQ ID NO: 207577 - protein, 36 aa, Artificial Sequence
  Description of Artificial Sequence: Synthetic polypeptide
DAEEIATTNPVGYAQWGCNTAGNNGLTTAELGNLDS

SEQ ID NO: 207578 - protein, 39 aa, Artificial Sequence
  Description of Artificial Sequence: Synthetic polypeptide
AEEEISTTNPVATEGYGQCVCSNWGEGHNAENFNSDTQS

SEQ ID NO: 207579 - protein, 38 aa, Artificial Sequence
  Description of Artificial Sequence: Synthetic polypeptide
QAEEIATTNPVATEQWGCTVNANAGEPGEQLDNEGHFT

SEQ ID NO: 207580 - protein, 39 aa, Artificial Sequence
  Description of Artificial Sequence: Synthetic polypeptide
DEEAISTTNPVATEGYGQCVCSNWGEDHNIEYFNSDTQS

SEQ ID NO: 207581 - protein, 39 aa, Artificial Sequence
  Description of Artificial Sequence: Synthetic polypeptide
DENEISTTNPVATEGYGQCAVCSWEEDHNAENFNSQFQS

SEQ ID NO: 207582 - protein, 39 aa, Artificial Sequence
  Description of Artificial Sequence: Synthetic polypeptide
DEMEIRTTNPVAYEQYGQCTCSNWNEDHNAENFNSDTQA

SEQ ID NO: 207583 - protein, 39 aa, Artificial Sequence
  Description of Artificial Sequence: Synthetic polypeptide
DEACIRTTNPVAYEQYGQCVCSNWEEDHNAENFNSDFQS

SEQ ID NO: 207584 - protein, 39 aa, Artificial Sequence
  Description of Artificial Sequence: Synthetic polypeptide
DENEISTTNPVATEGYGQCVCSNSEEDHNAENFISDNQA

SEQ ID NO: 207585 - protein, 39 aa, Artificial Sequence
  Description of Artificial Sequence: Synthetic polypeptide
DEMEISCTNPVATEQYGQCVCSNWEEDHNAENFNSDTQS

SEQ ID NO: 207586 - protein, 39 aa, Artificial Sequence
  Description of Artificial Sequence: Synthetic polypeptide
DEMEISCTNPVATEQYGQCVCSNWGEDHNAENFNSENQS

SEQ ID NO: 207587 - protein, 39 aa, Artificial Sequence
  Description of Artificial Sequence: Synthetic polypeptide
DEMEISCTNPVATEQYGQCVCSNWGEDPNAEFFGSDTQA

SEQ ID NO: 207588 - protein, 39 aa, Artificial Sequence
  Description of Artificial Sequence: Synthetic polypeptide
DEACISTTNPVATEQYGQCVCSNWGEGHNAENFNSDTQS

SEQ ID NO: 207589 - protein, 37 aa, Artificial Sequence
  Description of Artificial Sequence: Synthetic polypeptide
MEQEIATTNPVAYEQWGCVAGSNGFTEAGMPLEFDPW

SEQ ID NO: 207590 - protein, 39 aa, Artificial Sequence
  Description of Artificial Sequence: Synthetic polypeptide
ADECISTTNPVATEQYGQCVCSTWEEDHNAEHFNSDNQS

SEQ ID NO: 207591 - protein, 36 aa, Artificial Sequence
  Description of Artificial Sequence: Synthetic polypeptide
QEEEIATTNPVAYEWYGEHAPWCEHEISQQHNEGEW

SEQ ID NO: 207592 - protein, 38 aa, Artificial Sequence
  Description of Artificial Sequence: Synthetic polypeptide
DESEIRGTNPVATDAYGVVMEMQDNNLGVNEGGGQTTF

SEQ ID NO: 207593 - protein, 40 aa, Artificial Sequence
  Description of Artificial Sequence: Synthetic polypeptide
DENEIRTTNPVATEQYGTASCMCWAGVDLLQEVVVQEDDN

SEQ ID NO: 207594 - protein, 37 aa, Artificial Sequence
  Description of Artificial Sequence: Synthetic polypeptide
AENEIATTNPVATEGYGQCVCSWGEPNQEHFISETQA

SEQ ID NO: 207595 - protein, 39 aa, Artificial Sequence
  Description of Artificial Sequence: Synthetic polypeptide
DEAAIRTTNPVATEGYGQCVCSNWGEDHNAENFNSENQA

SEQ ID NO: 207596 - protein, 36 aa, Artificial Sequence
  Description of Artificial Sequence: Synthetic polypeptide
DETEIATTNPIATECWGATTSANAVDGWAEPKGPYP

SEQ ID NO: 207597 - protein, 35 aa, Artificial Sequence
  Description of Artificial Sequence: Synthetic polypeptide
DETEIATTNPIATECWGATTPANATDWAGPKGPYQ

SEQ ID NO: 207598 - protein, 36 aa, Artificial Sequence
  Description of Artificial Sequence: Synthetic polypeptide
DETEIATTNPIATECWGATTSANATHGPAEPKGPQN

SEQ ID NO: 207599 - protein, 36 aa, Artificial Sequence
  Description of Artificial Sequence: Synthetic polypeptide
DETEIATTNPIATECWGATTSANAGGGWPEPKGPYP

SEQ ID NO: 207600 - protein, 37 aa, Artificial Sequence
  Description of Artificial Sequence: Synthetic polypeptide
DETEIATTNPIATECWGATTSANATDGPAEPKGGPNN

SEQ ID NO: 207601 - protein, 39 aa, Artificial Sequence
  Description of Artificial Sequence: Synthetic polypeptide
AEEEISTTNPVATEGYGQCVCSNWGEDHNAEYFNSENQS

SEQ ID NO: 207602 - protein, 39 aa, Artificial Sequence
  Description of Artificial Sequence: Synthetic polypeptide
AEEEISTTNPVATEGYGQCVCSNWGEDHNAEYFNSETQS

SEQ ID NO: 207603 - protein, 38 aa, Artificial Sequence
  Description of Artificial Sequence: Synthetic polypeptide
DEMVIGTTNPVATEQWGICVCSWGDDDNAEYFNSDTQA

SEQ ID NO: 207604 - protein, 38 aa, Artificial Sequence
  Description of Artificial Sequence: Synthetic polypeptide
AENEIACTNPVATEQYGQCSCSNWEEDNQEYFGSDTQA

SEQ ID NO: 207605 - protein, 39 aa, Artificial Sequence
  Description of Artificial Sequence: Synthetic polypeptide
AEEEISTTNPVATEGYGQCVCSNWGEDHNIENFGSDTQS

SEQ ID NO: 207606 - protein, 36 aa, Artificial Sequence
  Description of Artificial Sequence: Synthetic polypeptide
DETEIATTNPIATECWGATTTALATDGPAEAKGPYN

SEQ ID NO: 207607 - protein, 39 aa, Artificial Sequence
  Description of Artificial Sequence: Synthetic polypeptide
CEMEISTTNPVATEQYGQCVCSNWGEDHNAENFNSETQA

SEQ ID NO: 207608 - protein, 35 aa, Artificial Sequence
  Description of Artificial Sequence: Synthetic polypeptide
TESEIASTNPVGTEGWGVCAPTDNQQNHQGQDMGP

SEQ ID NO: 207609 - protein, 39 aa, Artificial Sequence
  Description of Artificial Sequence: Synthetic polypeptide
AEEEISTTNPVATEGYGQCVCSNWGEDPNAENFNSDTQS

SEQ ID NO: 207610 - protein, 37 aa, Artificial Sequence
  Description of Artificial Sequence: Synthetic polypeptide
DETEIATTNPIATECWGATTTALATDGPAEPKGNGNN

SEQ ID NO: 207611 - protein, 39 aa, Artificial Sequence
  Description of Artificial Sequence: Synthetic polypeptide
MEPEIRTTNPVATEFYGCVVGSVNQTDGGEFEEEGGEED

SEQ ID NO: 207612 - protein, 39 aa, Artificial Sequence
  Description of Artificial Sequence: Synthetic polypeptide
DEEEIACTNPVATEQWGCNVVTAGDGHGEMTADQGGDFF

SEQ ID NO: 207613 - protein, 39 aa, Artificial Sequence
  Description of Artificial Sequence: Synthetic polypeptide
DEAEISTTNPVAYEQYGQCVCGNWGEAHNAENFNSDTQS

SEQ ID NO: 207614 - protein, 39 aa, Artificial Sequence
  Description of Artificial Sequence: Synthetic polypeptide
DEMCISTTNPVAYEQYGQCVCSNWGEDHNAENFNSDTQS

SEQ ID NO: 207615 - protein, 39 aa, Artificial Sequence
  Description of Artificial Sequence: Synthetic polypeptide
ADAEISTTNPVATEQYGQCVCSNWGEEHNAENFNSDNQN

SEQ ID NO: 207616 - protein, 38 aa, Artificial Sequence
  Description of Artificial Sequence: Synthetic polypeptide
DEDEIATTNPVATEQWGCNCAAGMGDHPGDNHPDDSNN

SEQ ID NO: 207617 - protein, 39 aa, Artificial Sequence
  Description of Artificial Sequence: Synthetic polypeptide
AEAEISTTNPVAYEGYGQCVCSNWGEGTNAENFNSDTQA

SEQ ID NO: 207618 - protein, 38 aa, Artificial Sequence
  Description of Artificial Sequence: Synthetic polypeptide
ADAEISTTNPVATEQYGQCVCSNWGEHNAENFISDFQS

SEQ ID NO: 207619 - protein, 39 aa, Artificial Sequence
  Description of Artificial Sequence: Synthetic polypeptide
DEAEISTTNPVAYEQYGQCVCGNWGEDHNAENFISDTQA

SEQ ID NO: 207620 - protein, 37 aa, Artificial Sequence
  Description of Artificial Sequence: Synthetic polypeptide
DEDEIATTNPVAYEPWGRPPAGQGPALQVHQDGDQAN

SEQ ID NO: 207621 - protein, 37 aa, Artificial Sequence
  Description of Artificial Sequence: Synthetic polypeptide
DEDEIATTNPVAYEPWGRPPAGAGPALQLHQDGTQAN

SEQ ID NO: 207622 - protein, 38 aa, Artificial Sequence
  Description of Artificial Sequence: Synthetic polypeptide
AEAEISTTNPVAYEGYGQCVCSNWEEHNTESFNSETQS

SEQ ID NO: 207623 - protein, 39 aa, Artificial Sequence
  Description of Artificial Sequence: Synthetic polypeptide
AEAEISTTNPVAYEGYGQCVCSTWGEEHNAENFNSDTQA

SEQ ID NO: 207624 - protein, 38 aa, Artificial Sequence
  Description of Artificial Sequence: Synthetic polypeptide
AEAEISTTNPVAYEQYGCVCGNWGEDHNAENFNSETQP

SEQ ID NO: 207625 - protein, 39 aa, Artificial Sequence
  Description of Artificial Sequence: Synthetic polypeptide
AEAEISTTNPVATEQWGQCVCSNWGEDHNAENFNSDTQA

SEQ ID NO: 207626 - protein, 39 aa, Artificial Sequence
  Description of Artificial Sequence: Synthetic polypeptide
AEAEISTTNPVAYEGYGQCVCSNWEEDTNAENFNSDTQQ

SEQ ID NO: 207627 - protein, 39 aa, Artificial Sequence
  Description of Artificial Sequence: Synthetic polypeptide
AEAEISTTNPVAYEGYGQCVCSNWEEDHNAENFQSDNQA

SEQ ID NO: 207628 - protein, 39 aa, Artificial Sequence
  Description of Artificial Sequence: Synthetic polypeptide
DEAEISTTNPVAYEQYGQCVCGNWGEDHNAENFISETQS

SEQ ID NO: 207629 - protein, 37 aa, Artificial Sequence
  Description of Artificial Sequence: Synthetic polypeptide
DEDEIATTNPVAYEPWGRPPPAGQGPALTHQDGAEAP

SEQ ID NO: 207630 - protein, 38 aa, Artificial Sequence
  Description of Artificial Sequence: Synthetic polypeptide
AEAEISTTNPVAYEGYGQCVCSNWGEHNAEGFNSENQA

SEQ ID NO: 207631 - protein, 37 aa, Artificial Sequence
  Description of Artificial Sequence: Synthetic polypeptide
DEDEIATTNPVAYEPWGRPPPAGQGPALQHQDGDPAV

SEQ ID NO: 207632 - protein, 39 aa, Artificial Sequence
  Description of Artificial Sequence: Synthetic polypeptide
AEECISTTNPVATEQYGQCVCSNWGEDHNAENFISDTQA

SEQ ID NO: 207633 - protein, 39 aa, Artificial Sequence
  Description of Artificial Sequence: Synthetic polypeptide
ADAEISTTNPVATEQYGQCVCSNWGEDPNTENFISETQS

SEQ ID NO: 207634 - protein, 37 aa, Artificial Sequence
  Description of Artificial Sequence: Synthetic polypeptide
DEMCIRTTNPLAYEQWGCVCSNWGEHNQESFISDTQA

SEQ ID NO: 207635 - protein, 39 aa, Artificial Sequence
  Description of Artificial Sequence: Synthetic polypeptide
CEEAISTTNPCATEQYGQCVCSNWGEDHNAENFNSDTQS

SEQ ID NO: 207636 - protein, 36 aa, Artificial Sequence
  Description of Artificial Sequence: Synthetic polypeptide
DAEEIATTNPVAYASWGCNTAGNNGLTTAEHGGVDS

SEQ ID NO: 207637 - protein, 39 aa, Artificial Sequence
  Description of Artificial Sequence: Synthetic polypeptide
AEAEISTTNPVATEQYGQCVCSNWGEDHNAENFISDTQA

SEQ ID NO: 207638 - protein, 40 aa, Artificial Sequence
  Description of Artificial Sequence: Synthetic polypeptide
DEMAISTTNPVATEQYGQCQVCGNSGEDDNTENFNSETQS

SEQ ID NO: 207639 - protein, 38 aa, Artificial Sequence
  Description of Artificial Sequence: Synthetic polypeptide
AEAEISTTNPVAYEGYGCVCSNWEEDHNAENFNSDPQL

SEQ ID NO: 207640 - protein, 38 aa, Artificial Sequence
  Description of Artificial Sequence: Synthetic polypeptide
DEMCISTTNPVAYEQYGCVCSNWGEDDNAEFFISDTQA

SEQ ID NO: 207641 - protein, 39 aa, Artificial Sequence
  Description of Artificial Sequence: Synthetic polypeptide
CEEAISTTNPVATEQYGQCVCSNWGEDHNAENFFSDTQA

SEQ ID NO: 207642 - protein, 39 aa, Artificial Sequence
  Description of Artificial Sequence: Synthetic polypeptide
DEREISTTNPVAYEGYGQCVCSNWGEDHNAENFISDNQA

SEQ ID NO: 207643 - protein, 39 aa, Artificial Sequence
  Description of Artificial Sequence: Synthetic polypeptide
ADEEISTTNPVAYEQYGCAVCSNWGEDHNAENFNSDTQA

SEQ ID NO: 207644 - protein, 38 aa, Artificial Sequence
  Description of Artificial Sequence: Synthetic polypeptide
AEAEISTTNPVAYEGYGCVCSNWGEDHNAENFNSDPQS

SEQ ID NO: 207645 - protein, 38 aa, Artificial Sequence
  Description of Artificial Sequence: Synthetic polypeptide
DEMCIVTTNPVAYEQYGCVCGNWGEDPNAEFFISDTQA

SEQ ID NO: 207646 - protein, 39 aa, Artificial Sequence
  Description of Artificial Sequence: Synthetic polypeptide
AEECISTTNPVATEQYGQCVCPNWGEDHNAENFNSETQN

SEQ ID NO: 207647 - protein, 39 aa, Artificial Sequence
  Description of Artificial Sequence: Synthetic polypeptide
AEAEISTTNPVATEGYGQCVCSNWGEDHNAENFNSDNQL

SEQ ID NO: 207648 - protein, 39 aa, Artificial Sequence
  Description of Artificial Sequence: Synthetic polypeptide
AEAEISTTNPVATEGYGQCVCSNWGEDHNAENFISENQS

SEQ ID NO: 207649 - protein, 39 aa, Artificial Sequence
  Description of Artificial Sequence: Synthetic polypeptide
AEECISTTNPVATEQYGQCVCGNWGEDHNAEYFNSDNQS

SEQ ID NO: 207650 - protein, 39 aa, Artificial Sequence
  Description of Artificial Sequence: Synthetic polypeptide
AEAEISTTNPVATEGYGQCVCSNWGEDHNTENFISDTQQ

SEQ ID NO: 207651 - protein, 40 aa, Artificial Sequence
  Description of Artificial Sequence: Synthetic polypeptide
DEAEISTTNPVATEQYGQCAVCSNSGEDHNAENFMSETQA

SEQ ID NO: 207652 - protein, 34 aa, Artificial Sequence
  Description of Artificial Sequence: Synthetic polypeptide
QEGEIACTNPCSYEQWGITCYCNDQQDHGDTAGE

SEQ ID NO: 207653 - protein, 39 aa, Artificial Sequence
  Description of Artificial Sequence: Synthetic polypeptide
DEMCISTTNPVAYEGYGQCVCSNWGELHNTENFISENQS

SEQ ID NO: 207654 - protein, 37 aa, Artificial Sequence
  Description of Artificial Sequence: Synthetic polypeptide
AEECIACVNPVCTEQYGVVCSNWGEHNQESFISDNQA

SEQ ID NO: 207655 - protein, 39 aa, Artificial Sequence
  Description of Artificial Sequence: Synthetic polypeptide
CEECISCTNPVATEQYGQCVCSNWGEDDNAENFNSDTQA

SEQ ID NO: 207656 - protein, 39 aa, Artificial Sequence
  Description of Artificial Sequence: Synthetic polypeptide
AEECISTTNPVATEQYGQCVCSNWGEDHNAENFISDTQS

SEQ ID NO: 207657 - protein, 36 aa, Artificial Sequence
  Description of Artificial Sequence: Synthetic polypeptide
DEDEIATTNPVAYAPWGTACAAAAGELPDSASNPRY

SEQ ID NO: 207658 - protein, 39 aa, Artificial Sequence
  Description of Artificial Sequence: Synthetic polypeptide
DEMCISTTNPVATEQYGQCVCSNWGEDPNAEYFISDTQA

SEQ ID NO: 207659 - protein, 38 aa, Artificial Sequence
  Description of Artificial Sequence: Synthetic polypeptide
DEAEISTTNSVAYCQYGCVCSNWGEDHNAEYFNSDNQS

SEQ ID NO: 207660 - protein, 34 aa, Artificial Sequence
  Description of Artificial Sequence: Synthetic polypeptide
QEGEIACTNPCSYEQWGITCYCNDQQDDGDTVTE

SEQ ID NO: 207661 - protein, 38 aa, Artificial Sequence
  Description of Artificial Sequence: Synthetic polypeptide
YGNEIRKTNNPVAFEGSGYVSCTNNWVYEPRWGSGDGT

SEQ ID NO: 207662 - protein, 39 aa, Artificial Sequence
  Description of Artificial Sequence: Synthetic polypeptide
AEECISTTNPVATEQYGQCVCSNWGEDHNAENFISETQA

SEQ ID NO: 207663 - protein, 39 aa, Artificial Sequence
  Description of Artificial Sequence: Synthetic polypeptide
DEMCISTTNPVAYEGYGQCVCSNWEEDTNIENFNSDTQA

SEQ ID NO: 207664 - protein, 39 aa, Artificial Sequence
  Description of Artificial Sequence: Synthetic polypeptide
DEREISTTNPVAYEGYGQCVCSNWMEDHNAENFNSETQS

SEQ ID NO: 207665 - protein, 40 aa, Artificial Sequence
  Description of Artificial Sequence: Synthetic polypeptide
DEAEISTTNPVAYEQYGQCQVCSNWGEDHNAENFISDNQN

SEQ ID NO: 207666 - protein, 39 aa, Artificial Sequence
  Description of Artificial Sequence: Synthetic polypeptide
ADECISTTNPVAYEQYGQCVCSNWGELHNAEGFNSDNQP

SEQ ID NO: 207667 - protein, 40 aa, Artificial Sequence
  Description of Artificial Sequence: Synthetic polypeptide
DEAEISTTNPVAYEQYGQCQVCQNWGEDHNAEGFNSDTQS

SEQ ID NO: 207668 - protein, 39 aa, Artificial Sequence
  Description of Artificial Sequence: Synthetic polypeptide
DEMCISTTNPVAYEQYGQCVCSNWGEDPNAESFGSDTQA

SEQ ID NO: 207669 - protein, 39 aa, Artificial Sequence
  Description of Artificial Sequence: Synthetic polypeptide
AEECISTTNPVATEQYGQCVCSNWEEDHNIENFISDTQA

SEQ ID NO: 207670 - protein, 39 aa, Artificial Sequence
  Description of Artificial Sequence: Synthetic polypeptide
ADEEISTTNPVATEYYGQCVCSNWGEDHNAENFNSDTQS

SEQ ID NO: 207671 - protein, 36 aa, Artificial Sequence
  Description of Artificial Sequence: Synthetic polypeptide
DEDEIATTNPVAYAPWGHTACAATAGELPDSASNPH

SEQ ID NO: 207672 - protein, 39 aa, Artificial Sequence
  Description of Artificial Sequence: Synthetic polypeptide
DEMCISTTNPVAYEQYGQCVCSNWGEDHNAENFNSDTQG

SEQ ID NO: 207673 - protein, 37 aa, Artificial Sequence
  Description of Artificial Sequence: Synthetic polypeptide
AEECIASVNPVCTEQYGCVCSNWGEHNAESFISDNQA

SEQ ID NO: 207674 - protein, 36 aa, Artificial Sequence
  Description of Artificial Sequence: Synthetic polypeptide
DEDEIATTNPVAYAPWGTACAATAGELPDSASNPQM

SEQ ID NO: 207675 - protein, 39 aa, Artificial Sequence
  Description of Artificial Sequence: Synthetic polypeptide
CEECISTTNPVATEGYGQCVCSNWEEDPNAEGFNSDTQA

SEQ ID NO: 207676 - protein, 38 aa, Artificial Sequence
  Description of Artificial Sequence: Synthetic polypeptide
ADAEISTTNPVATEGYGCVCSMWGEDHNAENFNSDTQS

SEQ ID NO: 207677 - protein, 38 aa, Artificial Sequence
  Description of Artificial Sequence: Synthetic polypeptide
ADAEISTTNPVATEGYGCVCSNWGEDHNIENFNSQTQA

SEQ ID NO: 207678 - protein, 38 aa, Artificial Sequence
  Description of Artificial Sequence: Synthetic polypeptide
ADAEISTTNPVATEGYGCVCSNWGEDHNQENFNSDTQA

SEQ ID NO: 207679 - protein, 40 aa, Artificial Sequence
  Description of Artificial Sequence: Synthetic polypeptide
AEECISTTNPVATEQYGQCQVCSNWGEDHNAEYFNSDNQS

SEQ ID NO: 207680 - protein, 39 aa, Artificial Sequence
  Description of Artificial Sequence: Synthetic polypeptide
DEMCISTTNPVAYEQYGQCVCSNWGEDHNAEGFNSENQA

SEQ ID NO: 207681 - protein, 39 aa, Artificial Sequence
  Description of Artificial Sequence: Synthetic polypeptide
CEECISTTNPVATEGYGQCVCSNWGEDHNAEHFNSDTQA

SEQ ID NO: 207682 - protein, 38 aa, Artificial Sequence
  Description of Artificial Sequence: Synthetic polypeptide
AEECISTTNPVAYEGYGCVCSNWGEDHNAENFNSDTQG

SEQ ID NO: 207683 - protein, 39 aa, Artificial Sequence
  Description of Artificial Sequence: Synthetic polypeptide
AEEAISTTNPVAYEQYGQCVCSNWGEDHNAENFQSDTQP

SEQ ID NO: 207684 - protein, 40 aa, Artificial Sequence
  Description of Artificial Sequence: Synthetic polypeptide
CEECIRTTNPVATEGYGQCQVCSNWGEDHNAENFNSDTQP

SEQ ID NO: 207685 - protein, 39 aa, Artificial Sequence
  Description of Artificial Sequence: Synthetic polypeptide
AEAEISTTNPVATEGYGQCVCSNWGEDHNAEHFNSDTQL

SEQ ID NO: 207686 - protein, 39 aa, Artificial Sequence
  Description of Artificial Sequence: Synthetic polypeptide
AEAEISTTNPVATEGYGQCVCSNWGEDHNAEGFISENQA

SEQ ID NO: 207687 - protein, 39 aa, Artificial Sequence
  Description of Artificial Sequence: Synthetic polypeptide
ADAEISTTNPVATEQYGQCVCSNWEEDHNAEFFNSDTQN

SEQ ID NO: 207688 - protein, 39 aa, Artificial Sequence
  Description of Artificial Sequence: Synthetic polypeptide
ADAEISTTNPVATEQYGQCVCSNWGEDDNAEHFNSETQS

SEQ ID NO: 207689 - protein, 39 aa, Artificial Sequence
  Description of Artificial Sequence: Synthetic polypeptide
DEMCISTTNPVAYEQYGQCVCSNWGEDHNAENFNSDFQF

SEQ ID NO: 207690 - protein, 39 aa, Artificial Sequence
  Description of Artificial Sequence: Synthetic polypeptide
ADAEISTTNPVATEQYGQCVCSNWGEDPNAENFNSDTQS

SEQ ID NO: 207691 - protein, 39 aa, Artificial Sequence
  Description of Artificial Sequence: Synthetic polypeptide
CEECISTTNPVATEQWGQCVCSNWGELHNAENFNSDTQS

SEQ ID NO: 207692 - protein, 39 aa, Artificial Sequence
  Description of Artificial Sequence: Synthetic polypeptide
DEMCISTTNPVAYEQYGQCVCSNWGEDHNAEGFNSDTQS

SEQ ID NO: 207693 - protein, 39 aa, Artificial Sequence
  Description of Artificial Sequence: Synthetic polypeptide
DEAEISTTNPVAYEQYGQCVCENWGEDHNAENFNSDTQA

SEQ ID NO: 207694 - protein, 39 aa, Artificial Sequence
  Description of Artificial Sequence: Synthetic polypeptide
DEQEIRETTNMVEATEQIYCGVICYPAFNEVNVVSVPRR

SEQ ID NO: 207695 - protein, 36 aa, Artificial Sequence
  Description of Artificial Sequence: Synthetic polypeptide
DEDEIATTNPVAYAPWGTACAATAGELPPDSASNPE

SEQ ID NO: 207696 - protein, 34 aa, Artificial Sequence
  Description of Artificial Sequence: Synthetic polypeptide
QEGEIACTNPCSYEQWGITCYCNDQQDEGDTVGM

SEQ ID NO: 207697 - protein, 39 aa, Artificial Sequence
  Description of Artificial Sequence: Synthetic polypeptide
DEMCISTTNPVAYEQYGQCVCSNWGEDHNAESFNSDNQS

SEQ ID NO: 207698 - protein, 38 aa, Artificial Sequence
  Description of Artificial Sequence: Synthetic polypeptide
YEVEIVTTNPAATEAYGDCVTGTGGGDGETNDGGEGGT

SEQ ID NO: 207699 - protein, 38 aa, Artificial Sequence
  Description of Artificial Sequence: Synthetic polypeptide
ADAEISCTNPVATEQYGCVCSNWGEDHNAENFNSDTQA

SEQ ID NO: 207700 - protein, 38 aa, Artificial Sequence
  Description of Artificial Sequence: Synthetic polypeptide
AEAEISTTNPVAYEGYGCVCSNWGEDHNAENFNSDTQA

SEQ ID NO: 207701 - protein, 40 aa, Artificial Sequence
  Description of Artificial Sequence: Synthetic polypeptide
DEAEISTTNPVAYEQYGQCAVCSNWGEDPNIEYFNSDNQS

SEQ ID NO: 207702 - protein, 38 aa, Artificial Sequence
  Description of Artificial Sequence: Synthetic polypeptide
DEMEIATTNPVAYEGYGQCVCSNWMEHNAEHFISETQA

SEQ ID NO: 207703 - protein, 39 aa, Artificial Sequence
  Description of Artificial Sequence: Synthetic polypeptide
DEMCISTTNPVAYEQYGQCVCGNSGEDDNAENFNSDTQS

SEQ ID NO: 207704 - protein, 40 aa, Artificial Sequence
  Description of Artificial Sequence: Synthetic polypeptide
DEAEISTTNPVAYEQYGQCAVCSNWGEDDNAENFNSDTQS

SEQ ID NO: 207705 - protein, 39 aa, Artificial Sequence
  Description of Artificial Sequence: Synthetic polypeptide
AEAEISTTNPVATEQYGQCVCQNWGEDHNAENSNSDTQS

SEQ ID NO: 207706 - protein, 39 aa, Artificial Sequence
  Description of Artificial Sequence: Synthetic polypeptide
ADEEISTTNPVAYEQYGQCVCFTWGEDHNIENFFSENQS

SEQ ID NO: 207707 - protein, 39 aa, Artificial Sequence
  Description of Artificial Sequence: Synthetic polypeptide
DEMCISTTNPVAYEQYGQCVCSNWEEDHNAENFNSDTQA

SEQ ID NO: 207708 - protein, 39 aa, Artificial Sequence
  Description of Artificial Sequence: Synthetic polypeptide
AEAEISTTNPVATEQYGQCVCGNWGEDHNIENFGSDTQS

SEQ ID NO: 207709 - protein, 38 aa, Artificial Sequence
  Description of Artificial Sequence: Synthetic polypeptide
ADAAIGTTNPVAYEQYGQCVCSWGEDHNTENFNSDNAS

SEQ ID NO: 207710 - protein, 40 aa, Artificial Sequence
  Description of Artificial Sequence: Synthetic polypeptide
DEAEISTTNPVAYEQYGQCQVCSNWGEDPNAENFNSETQA

SEQ ID NO: 207711 - protein, 37 aa, Artificial Sequence
  Description of Artificial Sequence: Synthetic polypeptide
DEDEIATTNPVAYAPWGHTACAANAGELPDSASNPRN

SEQ ID NO: 207712 - protein, 39 aa, Artificial Sequence
  Description of Artificial Sequence: Synthetic polypeptide
ADAEIRTTNPVATEQYGQCVCGNWEEDHNAENFNSDNQM

SEQ ID NO: 207713 - protein, 39 aa, Artificial Sequence
  Description of Artificial Sequence: Synthetic polypeptide
AEAEISTTNPVATEGYGQCVCSNWGEDDNEENFNSDTQS

SEQ ID NO: 207714 - protein, 38 aa, Artificial Sequence
  Description of Artificial Sequence: Synthetic polypeptide
AEAAISTTNPVAYEQYGQCVCENWGEHNAEGFNSDTQN

SEQ ID NO: 207715 - protein, 39 aa, Artificial Sequence
  Description of Artificial Sequence: Synthetic polypeptide
DEREISTTNPVAYEGYGQCVCSNWGEDDNAENFNSDNQS

SEQ ID NO: 207716 - protein, 38 aa, Artificial Sequence
  Description of Artificial Sequence: Synthetic polypeptide
DEQEIATTNPVAYEQWGGCICAGTDGQDTQADMKYNEH

SEQ ID NO: 207717 - protein, 40 aa, Artificial Sequence
  Description of Artificial Sequence: Synthetic polypeptide
DEMCISTTNPVATEGYGQCQVCSTWEEDHNAENFNSEFQS

SEQ ID NO: 207718 - protein, 40 aa, Artificial Sequence
  Description of Artificial Sequence: Synthetic polypeptide
AEEAISTTNPVATEQYGQCQVCSNWEEDHNAENFNSDTQA

SEQ ID NO: 207719 - protein, 38 aa, Artificial Sequence
  Description of Artificial Sequence: Synthetic polypeptide
DEQEIATTNPVAYEPQWGPCTAGNNALTQATQDDKMTT

SEQ ID NO: 207720 - protein, 39 aa, Artificial Sequence
  Description of Artificial Sequence: Synthetic polypeptide
AEEAISTTNPVATEQYGQCVCQNWGEDHNAENFGSETQG

SEQ ID NO: 207721 - protein, 39 aa, Artificial Sequence
  Description of Artificial Sequence: Synthetic polypeptide
DEAEISTTNPVATEGYGQCVCSNWGEDHNAENFISETQS

SEQ ID NO: 207722 - protein, 35 aa, Artificial Sequence
  Description of Artificial Sequence: Synthetic polypeptide
AEAEIASTNPVGYEAYGQVVMAYHPGDSQHVGDID

SEQ ID NO: 207723 - protein, 39 aa, Artificial Sequence
  Description of Artificial Sequence: Synthetic polypeptide
DEAEISTTNPVATEGYGQCVCSNWGEDHNAENFISDFQS

SEQ ID NO: 207724 - protein, 38 aa, Artificial Sequence
  Description of Artificial Sequence: Synthetic polypeptide
CEEEIACTNPVATEQWGGCCTAAAGNGNPATAHHDTQG

SEQ ID NO: 207725 - protein, 38 aa, Artificial Sequence
  Description of Artificial Sequence: Synthetic polypeptide
AEAVIRTTNPVAYEQYGCVCENWGEDPNAEYFNSDTQS

SEQ ID NO: 207726 - protein, 39 aa, Artificial Sequence
  Description of Artificial Sequence: Synthetic polypeptide
DEAEISTTNPVATEGYGQCVCQDWGEDHNAENSNSENQA

SEQ ID NO: 207727 - protein, 36 aa, Artificial Sequence
  Description of Artificial Sequence: Synthetic polypeptide
DEDEIACTNPVAYEQWGCCAAAPGNHGNAEGGGTVN

SEQ ID NO: 207728 - protein, 39 aa, Artificial Sequence
  Description of Artificial Sequence: Synthetic polypeptide
DEAEISTTNPVATEGYGQCVCGNWGEDHNAEYFNSETQS

SEQ ID NO: 207729 - protein, 39 aa, Artificial Sequence
  Description of Artificial Sequence: Synthetic polypeptide
DEAEISTTNPVATEGYGQCVCGNWGEDHNAEYFNSETQA

SEQ ID NO: 207730 - protein, 39 aa, Artificial Sequence
  Description of Artificial Sequence: Synthetic polypeptide
AEECISTTNPVATEEYGQCVCSMWGEDHNAEHFNSDTQS

SEQ ID NO: 207731 - protein, 38 aa, Artificial Sequence
  Description of Artificial Sequence: Synthetic polypeptide
DEQEIATTNPVAYEQWGHCIIFAGNSGLVDNDQSEEDA

SEQ ID NO: 207732 - protein, 38 aa, Artificial Sequence
  Description of Artificial Sequence: Synthetic polypeptide
DEQEIATTNPVAYEQWGHCIIFAGNSGLVDNDTENDQM

SEQ ID NO: 207733 - protein, 39 aa, Artificial Sequence
  Description of Artificial Sequence: Synthetic polypeptide
DEMAISTTNPVATEGYGQCVCSNWGEDHNAENFNSDTQS

SEQ ID NO: 207734 - protein, 39 aa, Artificial Sequence
  Description of Artificial Sequence: Synthetic polypeptide
DEMCISTTNPVATEEYGQCVCSNWGEDHNAENFNSDNQP

SEQ ID NO: 207735 - protein, 38 aa, Artificial Sequence
  Description of Artificial Sequence: Synthetic polypeptide
DEMCISTTNPVATEGYGCVCSNWGEDPNAENFISDTQA

SEQ ID NO: 207736 - protein, 38 aa, Artificial Sequence
  Description of Artificial Sequence: Synthetic polypeptide
DESEIATTNPVAYAQWGGCTIFAGNNGATTANQGGDRQ

SEQ ID NO: 207737 - protein, 38 aa, Artificial Sequence
  Description of Artificial Sequence: Synthetic polypeptide
DESEIATTNPVAYAPQWGPSACAAANGDAMQATNDQHQ

SEQ ID NO: 207738 - protein, 39 aa, Artificial Sequence
  Description of Artificial Sequence: Synthetic polypeptide
AEEAISTTNPVATEEYGQCVCSNWGEDHNAEFFNSDTQL

SEQ ID NO: 207739 - protein, 38 aa, Artificial Sequence
  Description of Artificial Sequence: Synthetic polypeptide
AEEAISTTNPVATEGYGQCVCSNWGEHNEENFISDTQS

SEQ ID NO: 207740 - protein, 39 aa, Artificial Sequence
  Description of Artificial Sequence: Synthetic polypeptide
AEEAISTTNPVATEGYGQCVCSNWMEDHNAENFNSENQS

SEQ ID NO: 207741 - protein, 39 aa, Artificial Sequence
  Description of Artificial Sequence: Synthetic polypeptide
DEMCISCTNPVATEQYGQCVCSNWGEDHNAENFNSDTQS

SEQ ID NO: 207742 - protein, 39 aa, Artificial Sequence
  Description of Artificial Sequence: Synthetic polypeptide
AEECIRTTNPVAYEQYGQCVCGNWGEDHNAENFNSDTQS

SEQ ID NO: 207743 - protein, 37 aa, Artificial Sequence
  Description of Artificial Sequence: Synthetic polypeptide
DEDEIACTNPVAYEQWGHCIIFAGNSGLVDNDLNDAE

SEQ ID NO: 207744 - protein, 38 aa, Artificial Sequence
  Description of Artificial Sequence: Synthetic polypeptide
DEDEIACTNPVAYEQWGHCIIFAGNSGLVDNDGENDQM

SEQ ID NO: 207745 - protein, 39 aa, Artificial Sequence
  Description of Artificial Sequence: Synthetic polypeptide
DEQEIATTNPVAYEQWGHCIIKAGNSGLVDNDMGINDHN

SEQ ID NO: 207746 - protein, 38 aa, Artificial Sequence
  Description of Artificial Sequence: Synthetic polypeptide
DEQEIATTNPVAYEQWGHCIIFAGNTGLVDNDSEENAM

SEQ ID NO: 207747 - protein, 38 aa, Artificial Sequence
  Description of Artificial Sequence: Synthetic polypeptide
DEQEIATTNPVAYEQWGHCIIFAGNTGLVDNDGEDDAE

SEQ ID NO: 207748 - protein, 38 aa, Artificial Sequence
  Description of Artificial Sequence: Synthetic polypeptide
DEQEIATTNPVAYEQWGHCIIFAGNSGVLVDNDMSNDA

SEQ ID NO: 207749 - protein, 39 aa, Artificial Sequence
  Description of Artificial Sequence: Synthetic polypeptide
DEAEISTTNPVATEGYGQCVCGNWGEDHNAENFNSETQP

SEQ ID NO: 207750 - protein, 39 aa, Artificial Sequence
  Description of Artificial Sequence: Synthetic polypeptide
DEAEISTTNPVATEGYGQCVCGNWGEDHNAENFISETQA

SEQ ID NO: 207751 - protein, 39 aa, Artificial Sequence
  Description of Artificial Sequence: Synthetic polypeptide
DEAEISTTNPVATEGYGQCVCGNWEEDHNAENFNSDNQS

SEQ ID NO: 207752 - protein, 40 aa, Artificial Sequence
  Description of Artificial Sequence: Synthetic polypeptide
DEAEISTTNPVATEGYGQCQVCSNWGEGHNAENFNSDNQS

SEQ ID NO: 207753 - protein, 39 aa, Artificial Sequence
  Description of Artificial Sequence: Synthetic polypeptide
DEAEISTTNPVAYEGYGQCVCSDWGEDHNAENFNSDTQS

SEQ ID NO: 207754 - protein, 39 aa, Artificial Sequence
  Description of Artificial Sequence: Synthetic polypeptide
DEAEISTTNPVAYEYYGQCVCSNWEEDHNAEHFNSDTQA

SEQ ID NO: 207755 - protein, 39 aa, Artificial Sequence
  Description of Artificial Sequence: Synthetic polypeptide
DEAEISTTNPVAYEGYGQCVCSMWGEDHNAENFNSDFQG

SEQ ID NO: 207756 - protein, 39 aa, Artificial Sequence
  Description of Artificial Sequence: Synthetic polypeptide
DEAEISTTNPVAYEGYGQCVCSMWGEDHNAENFNSDPQA

SEQ ID NO: 207757 - protein, 39 aa, Artificial Sequence
  Description of Artificial Sequence: Synthetic polypeptide
DEAEISTTNPVAYEYYGQCVCSNWGEDHNAENFNSETQS

SEQ ID NO: 207758 - protein, 38 aa, Artificial Sequence
  Description of Artificial Sequence: Synthetic polypeptide
DEAEISTTNPIATEGWGCQTCGNAEEDNAENSGSDNQS

SEQ ID NO: 207759 - protein, 39 aa, Artificial Sequence
  Description of Artificial Sequence: Synthetic polypeptide
DEAEISTTNPVAYEGYGQCVCSMWGEDHNAENFNSDTQA

SEQ ID NO: 207760 - protein, 39 aa, Artificial Sequence
  Description of Artificial Sequence: Synthetic polypeptide
DEAEISTTNPVAYEGYGQCVCSNSGEDDNAENFNSDNQA

SEQ ID NO: 207761 - protein, 39 aa, Artificial Sequence
  Description of Artificial Sequence: Synthetic polypeptide
DEAEISTTNPVAYEGYGQCVCSNSGEDHNAENFNSDNQF

SEQ ID NO: 207762 - protein, 39 aa, Artificial Sequence
  Description of Artificial Sequence: Synthetic polypeptide
DEAEISTTNPVAYEYYGQCVCSNWGEDHNAESFNSDTQA

SEQ ID NO: 207763 - protein, 38 aa, Artificial Sequence
  Description of Artificial Sequence: Synthetic polypeptide
ADECISTTNPVATEGYGCVCSNWGEDHNAENFNSDNAS

SEQ ID NO: 207764 - protein, 39 aa, Artificial Sequence
  Description of Artificial Sequence: Synthetic polypeptide
DAEEIATTNPVAYEPWGHSVCAMANHADDSKAPGGNEHN

SEQ ID NO: 207765 - protein, 38 aa, Artificial Sequence
  Description of Artificial Sequence: Synthetic polypeptide
DEAEISTTNPCAYEGYGQCVCSNWGEHNAENFNSDTQS

SEQ ID NO: 207766 - protein, 39 aa, Artificial Sequence
  Description of Artificial Sequence: Synthetic polypeptide
DEAEISTTNPVAYEGYGQCVCSNSGEDHNAEYFNSDTQS

SEQ ID NO: 207767 - protein, 39 aa, Artificial Sequence
  Description of Artificial Sequence: Synthetic polypeptide
DEAEISTTNPVAYEGYGQCVCSNSMEDHNAENFNSDTQA

SEQ ID NO: 207768 - protein, 39 aa, Artificial Sequence
  Description of Artificial Sequence: Synthetic polypeptide
DEAEISTTNPVAYEGYGQCVCQNWGEDHNQENFNSDTQA

SEQ ID NO: 207769 - protein, 40 aa, Artificial Sequence
  Description of Artificial Sequence: Synthetic polypeptide
DEAEISTTNPVAYEGYGQCIVCSNWGEDDNTENFNSENQA

SEQ ID NO: 207770 - protein, 38 aa, Artificial Sequence
  Description of Artificial Sequence: Synthetic polypeptide
ADECISTTNPVATEGYGQCVCSNWGEHNAEGFNSDTQA

SEQ ID NO: 207771 - protein, 39 aa, Artificial Sequence
  Description of Artificial Sequence: Synthetic polypeptide
DEAEISTTNPVAYEGYGQCVCGNWGEDPNIEGFNSDPQS

SEQ ID NO: 207772 - protein, 40 aa, Artificial Sequence
  Description of Artificial Sequence: Synthetic polypeptide
DEAEISTTNPVATEGYGQCQVCSNWGEDHNTENFNSDTQQ

SEQ ID NO: 207773 - protein, 39 aa, Artificial Sequence
  Description of Artificial Sequence: Synthetic polypeptide
DEMCISCTNPVATEGYGQCVCSNWGEDTNAENFNSENQA

SEQ ID NO: 207774 - protein, 40 aa, Artificial Sequence
  Description of Artificial Sequence: Synthetic polypeptide
DEAEISTTNPVATEGYGQCQVCSNWGEDHNAENFNSETQA

SEQ ID NO: 207775 - protein, 40 aa, Artificial Sequence
  Description of Artificial Sequence: Synthetic polypeptide
DEAEISTTNPVATEGYGQCQVCSNWGEDHNAENFNSDTQF

SEQ ID NO: 207776 - protein, 38 aa, Artificial Sequence
  Description of Artificial Sequence: Synthetic polypeptide
DEAEISTTNPVAYEGYGQCVCGNWEEHNAENFNSDNQM

SEQ ID NO: 207777 - protein, 40 aa, Artificial Sequence
  Description of Artificial Sequence: Synthetic polypeptide
DEAEISTTNPVATEGYGQCQVCSNWGEDHNAEGFNSDTQS

SEQ ID NO: 207778 - protein, 40 aa, Artificial Sequence
  Description of Artificial Sequence: Synthetic polypeptide
DEAEISTTNPVATEGYGQCAVCSNWGEDHNTEGFISDNQS

SEQ ID NO: 207779 - protein, 40 aa, Artificial Sequence
  Description of Artificial Sequence: Synthetic polypeptide
DEAEISTTNPVATEGYGQCAVCSNWGEDHNIEYFNSDTQA

SEQ ID NO: 207780 - protein, 40 aa, Artificial Sequence
  Description of Artificial Sequence: Synthetic polypeptide
DEAEISTTNPVATEGYGQCAVCSNWGEDHNAENFNSDTQA

SEQ ID NO: 207781 - protein, 38 aa, Artificial Sequence
  Description of Artificial Sequence: Synthetic polypeptide
ADNEIACTNPVATEQYGICSCSNWGEDNQEYFNSDTQS

SEQ ID NO: 207782 - protein, 39 aa, Artificial Sequence
  Description of Artificial Sequence: Synthetic polypeptide
DEAEISTTNPVATEGWGQCVCSNWMEDHNAENFNSETQS

SEQ ID NO: 207783 - protein, 39 aa, Artificial Sequence
  Description of Artificial Sequence: Synthetic polypeptide
DEAEISTTNPVATEGWGQCVCSNWGEDHNAENFNSDTQS

SEQ ID NO: 207784 - protein, 39 aa, Artificial Sequence
  Description of Artificial Sequence: Synthetic polypeptide
DEAEISTTNPVATEEYGQCVCSNWGEDHNAENFISDFQS

SEQ ID NO: 207785 - protein, 39 aa, Artificial Sequence
  Description of Artificial Sequence: Synthetic polypeptide
DEAEISTTNPVAYEQYGQCVCYNWGEDHNAENFNSDTQS

SEQ ID NO: 207786 - protein, 39 aa, Artificial Sequence
  Description of Artificial Sequence: Synthetic polypeptide
AEECISTTNPVATEEYGQCVCSNWGEDHNAESFNSDNQS

SEQ ID NO: 207787 - protein, 39 aa, Artificial Sequence
  Description of Artificial Sequence: Synthetic polypeptide
DEAEISTTNPVATEAYGQCVCGNWGEDHNIENFNSDTQS

SEQ ID NO: 207788 - protein, 36 aa, Artificial Sequence
  Description of Artificial Sequence: Synthetic polypeptide
ADNEIATTNPVAYEGYGCVCSWGEDNQEHFISETQA

SEQ ID NO: 207789 - protein, 39 aa, Artificial Sequence
  Description of Artificial Sequence: Synthetic polypeptide
DEAEISTTNPVAYEGYGQCAVCSNWGEHNAENFNSDTQS

SEQ ID NO: 207790 - protein, 34 aa, Artificial Sequence
  Description of Artificial Sequence: Synthetic polypeptide
AEAEIASTNPVGTEAWGVCAPTDRDQHQQQHQHD

SEQ ID NO: 207791 - protein, 39 aa, Artificial Sequence
  Description of Artificial Sequence: Synthetic polypeptide
AEACISTTNPVATEQYGQCVCSNWGEDHNAENFNSDTAA

SEQ ID NO: 207792 - protein, 39 aa, Artificial Sequence
  Description of Artificial Sequence: Synthetic polypeptide
AEACISTTNPVATEQYGQCVCSNWGEDHNAENFNSETQM

SEQ ID NO: 207793 - protein, 39 aa, Artificial Sequence
  Description of Artificial Sequence: Synthetic polypeptide
AEACISTTNPVATEQYGQCVCSNWGEDHNAESFNSDFQA

SEQ ID NO: 207794 - protein, 40 aa, Artificial Sequence
  Description of Artificial Sequence: Synthetic polypeptide
DEAEISTTNPVATEQYGQCVVCSNSGEDHNEENFPSDTQL

SEQ ID NO: 207795 - protein, 39 aa, Artificial Sequence
  Description of Artificial Sequence: Synthetic polypeptide
AEACISTTNPVATEQYGQCVCSNWGEDPNAEHFNSETQS

SEQ ID NO: 207796 - protein, 39 aa, Artificial Sequence
  Description of Artificial Sequence: Synthetic polypeptide
AEACISTTNPVATEQYGQCVCSNWGEGHNAEGFNSDNQA

SEQ ID NO: 207797 - protein, 38 aa, Artificial Sequence
  Description of Artificial Sequence: Synthetic polypeptide
AEACISTTNPVAYEAYGQCVCSNWMEHNTENFNSDNQA

SEQ ID NO: 207798 - protein, 39 aa, Artificial Sequence
  Description of Artificial Sequence: Synthetic polypeptide
AEACISTTNPVAYEQYGQCVCSNWGEDTNAENFNSDTQS

SEQ ID NO: 207799 - protein, 38 aa, Artificial Sequence
  Description of Artificial Sequence: Synthetic polypeptide
CEDEISTTNPVAYEQWGVACYTGDELHMDQNTQGQDDD

SEQ ID NO: 207800 - protein, 37 aa, Artificial Sequence
  Description of Artificial Sequence: Synthetic polypeptide
CEEEIACTNPVATEQWGCTVIFAHAGMHGPDDSGEGA

SEQ ID NO: 207801 - protein, 39 aa, Artificial Sequence
  Description of Artificial Sequence: Synthetic polypeptide
DEAEISTTNPVAYCQYGQCVCSNWGEDHNAENFNSDTQA

SEQ ID NO: 207802 - protein, 39 aa, Artificial Sequence
  Description of Artificial Sequence: Synthetic polypeptide
DEAEISTTNPVAYEEYGQCVCSNSGEDHNAESFNSDTQA

SEQ ID NO: 207803 - protein, 37 aa, Artificial Sequence
  Description of Artificial Sequence: Synthetic polypeptide
AEACVSTTNPVATEQYGCVCSNWGEHDAEYIGSDTQS

SEQ ID NO: 207804 - protein, 39 aa, Artificial Sequence
  Description of Artificial Sequence: Synthetic polypeptide
DEMEIGTTNPVATEGYGQCVCSNWGEDPNAEFFISDTQA

SEQ ID NO: 207805 - protein, 38 aa, Artificial Sequence
  Description of Artificial Sequence: Synthetic polypeptide
ADREISTTNPVAYEQYGCVCSNWGEDHNAENFNSDTQS

SEQ ID NO: 207806 - protein, 39 aa, Artificial Sequence
  Description of Artificial Sequence: Synthetic polypeptide
AEACISTTNPVATEQYGQCVCSNWGEDHNAENFISDNQS

SEQ ID NO: 207807 - protein, 39 aa, Artificial Sequence
  Description of Artificial Sequence: Synthetic polypeptide
ADEEISTTNPVATEQWGQCVCSMSGEDHNAESFNSDTQA

SEQ ID NO: 207808 - protein, 39 aa, Artificial Sequence
  Description of Artificial Sequence: Synthetic polypeptide
AEACISTTNPVATEQYGQCVCSNWGEDHNAENFGSETQS

SEQ ID NO: 207809 - protein, 39 aa, Artificial Sequence
  Description of Artificial Sequence: Synthetic polypeptide
AEACISTTNPVATEGYGQCVCSTWGEDHNAEYFNSENQA

SEQ ID NO: 207810 - protein, 39 aa, Artificial Sequence
  Description of Artificial Sequence: Synthetic polypeptide
AEAAISTTNPVAYEQYGQCVCSNWMEDHNAENFGSENQS

SEQ ID NO: 207811 - protein, 39 aa, Artificial Sequence
  Description of Artificial Sequence: Synthetic polypeptide
DEAEISTTNPVAYCGYGQCVCSNWGEDHNAENFQSDNQS

SEQ ID NO: 207812 - protein, 37 aa, Artificial Sequence
  Description of Artificial Sequence: Synthetic polypeptide
AEACIATTNPVATEQYGCFCPNWGEDNAEHFSSETQS

SEQ ID NO: 207813 - protein, 39 aa, Artificial Sequence
  Description of Artificial Sequence: Synthetic polypeptide
AEAAIRTTNPVAYEQYGQCVCSNWGEDHNAENFNSDNQM

SEQ ID NO: 207814 - protein, 39 aa, Artificial Sequence
  Description of Artificial Sequence: Synthetic polypeptide
AEAAIRTTNPVAYEQYGQCVCSNWGEDHNAEHFNSENQS

SEQ ID NO: 207815 - protein, 39 aa, Artificial Sequence
  Description of Artificial Sequence: Synthetic polypeptide
AEACIGTTNPVAYEQYGQCVCSNWGEDHNTENFNSDNQS

SEQ ID NO: 207816 - protein, 39 aa, Artificial Sequence
  Description of Artificial Sequence: Synthetic polypeptide
AEACIRTTNPVATEGYGQCVCSNWGEDHNAENFNSETQS

SEQ ID NO: 207817 - protein, 39 aa, Artificial Sequence
  Description of Artificial Sequence: Synthetic polypeptide
AEAAIGTTNPVAYEQYGQCVCSNWPEDHNTENFISDNQA

SEQ ID NO: 207818 - protein, 34 aa, Artificial Sequence
  Description of Artificial Sequence: Synthetic polypeptide
QEGEIAATNPCSYEQWGITCYCNDQQDQSGDTVH

SEQ ID NO: 207819 - protein, 40 aa, Artificial Sequence
  Description of Artificial Sequence: Synthetic polypeptide
AEACIRTTNPVATEQYGQCAVCSNWGEDHNAENFNSDTQL

SEQ ID NO: 207820 - protein, 39 aa, Artificial Sequence
  Description of Artificial Sequence: Synthetic polypeptide
AEACIRTTNPVATEQYGQCVCSNWGEDHNAENFMSDTQS

SEQ ID NO: 207821 - protein, 38 aa, Artificial Sequence
  Description of Artificial Sequence: Synthetic polypeptide
AEACISTTNPVATEEYGQCVCSNWGEHNAENFNSDTQG

SEQ ID NO: 207822 - protein, 39 aa, Artificial Sequence
  Description of Artificial Sequence: Synthetic polypeptide
AEACISTTNPVATEGYGCIVCSNWGEDHNTENFNSENQA

SEQ ID NO: 207823 - protein, 39 aa, Artificial Sequence
  Description of Artificial Sequence: Synthetic polypeptide
AEACISTTNPVATEGYGQCVCSTWGEDHNAENFNSDTAS

SEQ ID NO: 207824 - protein, 38 aa, Artificial Sequence
  Description of Artificial Sequence: Synthetic polypeptide
DEMCISTTNPLATEQFGCVCSNWGEDHNQESFNSDTQA

SEQ ID NO: 207825 - protein, 39 aa, Artificial Sequence
  Description of Artificial Sequence: Synthetic polypeptide
AEACISTTNPVATEQYGQCSCSNWGEDHNIENFNSDTQS

SEQ ID NO: 207826 - protein, 40 aa, Artificial Sequence
  Description of Artificial Sequence: Synthetic polypeptide
AEECISTTNPVATEGYGQCIVCSNWGEDDNTENFNSENQA

SEQ ID NO: 207827 - protein, 39 aa, Artificial Sequence
  Description of Artificial Sequence: Synthetic polypeptide
DEAEISTTNPVATEQWGQCVCGNWGEDHNAENFNSDNQA

SEQ ID NO: 207828 - protein, 39 aa, Artificial Sequence
  Description of Artificial Sequence: Synthetic polypeptide
ADEEISTTNPVATEGYGQCVCSNWGEDHNAENFNSDTAP

SEQ ID NO: 207829 - protein, 38 aa, Artificial Sequence
  Description of Artificial Sequence: Synthetic polypeptide
ADEEISCTNPVAYEQYGQCVCSNWGEHNAENFISDNQA

SEQ ID NO: 207830 - protein, 40 aa, Artificial Sequence
  Description of Artificial Sequence: Synthetic polypeptide
ADEEISTTNPVATEQYGQCAVCSTWGEPHNAENFISEFQS

SEQ ID NO: 207831 - protein, 40 aa, Artificial Sequence
  Description of Artificial Sequence: Synthetic polypeptide
ADEEISTTNPVATEQYGQCQVCSNWGEDHNAENFSSDNQS

SEQ ID NO: 207832 - protein, 39 aa, Artificial Sequence
  Description of Artificial Sequence: Synthetic polypeptide
ADEEISTTNPVATEQYGQCVCSNWEEDHNAEGFISDTQS

SEQ ID NO: 207833 - protein, 38 aa, Artificial Sequence
  Description of Artificial Sequence: Synthetic polypeptide
CEEEIACTNPVAYEQWGHCWFTATGELADIGNSDESAM

SEQ ID NO: 207834 - protein, 39 aa, Artificial Sequence
  Description of Artificial Sequence: Synthetic polypeptide
ADEEISTTNPVATEQYGQCVCSNWGEDHNAENFFSDTQA

SEQ ID NO: 207835 - protein, 39 aa, Artificial Sequence
  Description of Artificial Sequence: Synthetic polypeptide
DECANEIATTNPVAYERWGSVACQQPNEEQGEQMGMDKS

SEQ ID NO: 207836 - protein, 39 aa, Artificial Sequence
  Description of Artificial Sequence: Synthetic polypeptide
ADNEISTTNPVATEQYGQCVCSMWGEDHNAENFGSDTQA

SEQ ID NO: 207837 - protein, 39 aa, Artificial Sequence
  Description of Artificial Sequence: Synthetic polypeptide
DEAVISTTNPVATEQYGICVCENWGEDPNAEYFISDTQS

SEQ ID NO: 207838 - protein, 37 aa, Artificial Sequence
  Description of Artificial Sequence: Synthetic polypeptide
DEQEIATTNPVAYEQWGPCTAGNNALTEATPDDKMTK

SEQ ID NO: 207839 - protein, 36 aa, Artificial Sequence
  Description of Artificial Sequence: Synthetic polypeptide
AEAEIASTNPIGYEAYGQVVMAAYSPGLSQHVGDID

SEQ ID NO: 207840 - protein, 39 aa, Artificial Sequence
  Description of Artificial Sequence: Synthetic polypeptide
DEAEISTTNPVAYEQYGQCVCSNWGEDHNIENFISDTQA

SEQ ID NO: 207841 - protein, 37 aa, Artificial Sequence
  Description of Artificial Sequence: Synthetic polypeptide
DEMAIGTTNPVATEQYGCYLCTATDGWPVEKFETDKQ

SEQ ID NO: 207842 - protein, 38 aa, Artificial Sequence
  Description of Artificial Sequence: Synthetic polypeptide
DEQEIATTNPVAYEQWGHCTDAGNNALTQATPDDKMTE

SEQ ID NO: 207843 - protein, 38 aa, Artificial Sequence
  Description of Artificial Sequence: Synthetic polypeptide
ADNEISTTNPVATEGYGQCVCSNWGEPNAENFNSDNQS

SEQ ID NO: 207844 - protein, 38 aa, Artificial Sequence
  Description of Artificial Sequence: Synthetic polypeptide
CEDEIATTNPVAYEQWGSIICPAVADAGDDHQMDNAEM

SEQ ID NO: 207845 - protein, 39 aa, Artificial Sequence
  Description of Artificial Sequence: Synthetic polypeptide
ADEEISTTNPVATEGYGQCVCSNWMEDHNAENFNSENQP

SEQ ID NO: 207846 - protein, 38 aa, Artificial Sequence
  Description of Artificial Sequence: Synthetic polypeptide
CEDEIATTNPVAYEQWGSIPAIANNDLDTATPGGSMAY

SEQ ID NO: 207847 - protein, 39 aa, Artificial Sequence
  Description of Artificial Sequence: Synthetic polypeptide
DEAEISTTNPVAYEQYGQCVCSNWGEDHNAENFISDTQS

SEQ ID NO: 207848 - protein, 40 aa, Artificial Sequence
  Description of Artificial Sequence: Synthetic polypeptide
ADEAIRTTNPVATEQYGQCAVCSNWGEPHNAENFNSDTQS

SEQ ID NO: 207849 - protein, 39 aa, Artificial Sequence
  Description of Artificial Sequence: Synthetic polypeptide
ADAEISTTNPVAYEQYGQCVCQNWGELPNAEGFNSDNQA

SEQ ID NO: 207850 - protein, 39 aa, Artificial Sequence
  Description of Artificial Sequence: Synthetic polypeptide
ADEEISTTNPVATEGYGQCVCSNWGEDHNAENFGSDTQS

SEQ ID NO: 207851 - protein, 37 aa, Artificial Sequence
  Description of Artificial Sequence: Synthetic polypeptide
CEEEIACTNPVAYEQWGCIAGPGPALGQNHQMINQAE

SEQ ID NO: 207852 - protein, 37 aa, Artificial Sequence
  Description of Artificial Sequence: Synthetic polypeptide
DAEEIATTNPVAYYAQWGCNTAGNNGPTEAEDGNLDS

SEQ ID NO: 207853 - protein, 39 aa, Artificial Sequence
  Description of Artificial Sequence: Synthetic polypeptide
DEAEISTTNPVAYEQYGQCVCSNWGEDHNAENFISDTQA

SEQ ID NO: 207854 - protein, 37 aa, Artificial Sequence
  Description of Artificial Sequence: Synthetic polypeptide
AEAEIACTNPVGTEGYGQCSCQSGEDNAEHFNSDTQA

SEQ ID NO: 207855 - protein, 37 aa, Artificial Sequence
  Description of Artificial Sequence: Synthetic polypeptide
AEAEIACTNPVGTEGYGVSCGMSGEHNAEHFGSDTQA

SEQ ID NO: 207856 - protein, 38 aa, Artificial Sequence
  Description of Artificial Sequence: Synthetic polypeptide
ADAEISTTNPVAYEQYGCVCSNWGEDHNAENFNSDNQM

SEQ ID NO: 207857 - protein, 38 aa, Artificial Sequence
  Description of Artificial Sequence: Synthetic polypeptide
ADAEISTTNPVAYEQYGCVCQNWGEDPNIEGFNSDNQA

SEQ ID NO: 207858 - protein, 39 aa, Artificial Sequence
  Description of Artificial Sequence: Synthetic polypeptide
DEREISTTNPVATEGYGQCVCPNWGEDHNAENFNSDTQA

SEQ ID NO: 207859 - protein, 38 aa, Artificial Sequence
  Description of Artificial Sequence: Synthetic polypeptide
DEMCIATTNPVATEGYGCVCSNWMEDHNEEHFISETQA

SEQ ID NO: 207860 - protein, 37 aa, Artificial Sequence
  Description of Artificial Sequence: Synthetic polypeptide
AEAEIACTNPVGTEGYGVSCGSGEDHNAEHFNSDTQA

SEQ ID NO: 207861 - protein, 36 aa, Artificial Sequence
  Description of Artificial Sequence: Synthetic polypeptide
AEAEIACTNPVGYEGYGVSCGNSGEHNAHFGSDTQS

SEQ ID NO: 207862 - protein, 39 aa, Artificial Sequence
  Description of Artificial Sequence: Synthetic polypeptide
DERAISTTNPVAYEQYGQCVCSNWEEDHNAEHFNSDTQS

SEQ ID NO: 207863 - protein, 37 aa, Artificial Sequence
  Description of Artificial Sequence: Synthetic polypeptide
CEDVIACTNPVATEQWGCCNATIGAHTNPPDQTEGRN

SEQ ID NO: 207864 - protein, 39 aa, Artificial Sequence
  Description of Artificial Sequence: Synthetic polypeptide
AEECISTTNPVATEGYGQCIVCSNWGEHNAENFNSETQS

SEQ ID NO: 207865 - protein, 40 aa, Artificial Sequence
  Description of Artificial Sequence: Synthetic polypeptide
AEECISTTNPVATEGYGQCQVCSTWGEDHNAEGFNSDTQS

SEQ ID NO: 207866 - protein, 39 aa, Artificial Sequence
  Description of Artificial Sequence: Synthetic polypeptide
DEAEISTTNPVAYEGYGQCVCSNWEEDDNAEFFNSDNQS

SEQ ID NO: 207867 - protein, 39 aa, Artificial Sequence
  Description of Artificial Sequence: Synthetic polypeptide
CEEEIATTNPVAYEQPYGTNPSNGGGGPGNNAGDDQADE

SEQ ID NO: 207868 - protein, 39 aa, Artificial Sequence
  Description of Artificial Sequence: Synthetic polypeptide
AEAEISTTNPVAYEQYGQCVCSNWGEGHNAEGFNSDNQS

SEQ ID NO: 207869 - protein, 37 aa, Artificial Sequence
  Description of Artificial Sequence: Synthetic polypeptide
DAEEIATTNPVAYAQWGCNTAGNNGPTTTAEGGNLES

SEQ ID NO: 207870 - protein, 35 aa, Artificial Sequence
  Description of Artificial Sequence: Synthetic polypeptide
DDSEVASTNPVSYEGYGNTVACNTEISGSRTGGQA

SEQ ID NO: 207871 - protein, 38 aa, Artificial Sequence
  Description of Artificial Sequence: Synthetic polypeptide
DEMEIATTNPCATEGWGCQSCQNWEEDNAENSGSDNQA

SEQ ID NO: 207872 - protein, 35 aa, Artificial Sequence
  Description of Artificial Sequence: Synthetic polypeptide
DDTEIATTNPIATECWGATTWANAEDWAEPKGPYI

SEQ ID NO: 207873 - protein, 39 aa, Artificial Sequence
  Description of Artificial Sequence: Synthetic polypeptide
ADEEISTTNPVAYEQYGQCVCSNWGEDDNAESFNSDTQS

SEQ ID NO: 207874 - protein, 39 aa, Artificial Sequence
  Description of Artificial Sequence: Synthetic polypeptide
ADEEISTTNPVAYEQYGQCVCSNWEEDDNAENFNSDTQP

SEQ ID NO: 207875 - protein, 40 aa, Artificial Sequence
  Description of Artificial Sequence: Synthetic polypeptide
DEMAISTTNPVATEQYGQCAVCSNWEEDHNAENFNSDTQS

SEQ ID NO: 207876 - protein, 37 aa, Artificial Sequence
  Description of Artificial Sequence: Synthetic polypeptide
CEEEIACTNPVATAQWGANCAAQNPPVNTAGNPEGTG

SEQ ID NO: 207877 - protein, 39 aa, Artificial Sequence
  Description of Artificial Sequence: Synthetic polypeptide
CEEEIAACTNPVAYEQWGHCNVAATTNLEAPGEQTEEAD

SEQ ID NO: 207878 - protein, 39 aa, Artificial Sequence
  Description of Artificial Sequence: Synthetic polypeptide
CEECISTTNPVAYEQYGQCVCSMSGEDHNAEHFISDNQN

SEQ ID NO: 207879 - protein, 39 aa, Artificial Sequence
  Description of Artificial Sequence: Synthetic polypeptide
AEAEISTTNPVAYEQYGQCVCSNWGEDHNAEYFGSETQS

SEQ ID NO: 207880 - protein, 39 aa, Artificial Sequence
  Description of Artificial Sequence: Synthetic polypeptide
DEAEISTTNPVAYEQYGQCVCSNSGEDHNAENFISDTQQ

SEQ ID NO: 207881 - protein, 39 aa, Artificial Sequence
  Description of Artificial Sequence: Synthetic polypeptide
DESEIRTTNCVATEAYGAATNGAGDDNDGEGQGGMEGGQ

SEQ ID NO: 207882 - protein, 39 aa, Artificial Sequence
  Description of Artificial Sequence: Synthetic polypeptide
CEEEIATTNPVAYEQPYGTNPSGVGGGPGNNAGDDQAAD

SEQ ID NO: 207883 - protein, 39 aa, Artificial Sequence
  Description of Artificial Sequence: Synthetic polypeptide
AEAEIRTTNPVAYEGYGQCVCSNWEEDHNAENFNSDNQS

SEQ ID NO: 207884 - protein, 36 aa, Artificial Sequence
  Description of Artificial Sequence: Synthetic polypeptide
VESEIRSTNPVSTEPWGCIAPEDGQQQQQQRYGTES

SEQ ID NO: 207885 - protein, 36 aa, Artificial Sequence
  Description of Artificial Sequence: Synthetic polypeptide
VESEIRTTNPVSTEPWGCIAPEDGQQQQQQAHGTES

SEQ ID NO: 207886 - protein, 39 aa, Artificial Sequence
  Description of Artificial Sequence: Synthetic polypeptide
DEMAISTTNPVAYEQYGQCVCSNWGEDHNAEGFNSDTQS

SEQ ID NO: 207887 - protein, 39 aa, Artificial Sequence
  Description of Artificial Sequence: Synthetic polypeptide
ADEEISTTNPVAYEQYGQCVCSNWGEDPNTENSNSDTQA

SEQ ID NO: 207888 - protein, 39 aa, Artificial Sequence
  Description of Artificial Sequence: Synthetic polypeptide
ADEEISTTNPVAYEQYGQCVCSNWGEDPNAENFNSETQA

SEQ ID NO: 207889 - protein, 39 aa, Artificial Sequence
  Description of Artificial Sequence: Synthetic polypeptide
AEAEIATTNPVAYEQYGQCVCSNWGEDHNAENFNSETQS

SEQ ID NO: 207890 - protein, 38 aa, Artificial Sequence
  Description of Artificial Sequence: Synthetic polypeptide
DEAEISTTNPVAYEQWGQCVCGNWGEHNAENFNSETQS

SEQ ID NO: 207891 - protein, 38 aa, Artificial Sequence
  Description of Artificial Sequence: Synthetic polypeptide
DEMAISTTNPVAYEGYGQCVCSNWGEHNAENFNSDNQL

SEQ ID NO: 207892 - protein, 39 aa, Artificial Sequence
  Description of Artificial Sequence: Synthetic polypeptide
ADEEISTTNPVAYEQYGQCVCSNWGEDHNAEYSNSDTQS

SEQ ID NO: 207893 - protein, 38 aa, Artificial Sequence
  Description of Artificial Sequence: Synthetic polypeptide
CEEEIACTNPVATASWGTICSEANPALPNDHGGGMNAW

SEQ ID NO: 207894 - protein, 39 aa, Artificial Sequence
  Description of Artificial Sequence: Synthetic polypeptide
ADEEISTTNPVAYEQYGQCVCSNWGEDHNAENFGSETQQ

SEQ ID NO: 207895 - protein, 38 aa, Artificial Sequence
  Description of Artificial Sequence: Synthetic polypeptide
DEMAISTTNPVAYEGYGQCVCSNWGEHNAENFNSDNQG

SEQ ID NO: 207896 - protein, 38 aa, Artificial Sequence
  Description of Artificial Sequence: Synthetic polypeptide
DEMAISTTNPVAYEGYGQCVCSNWEEHNAENFNSDTQS

SEQ ID NO: 207897 - protein, 39 aa, Artificial Sequence
  Description of Artificial Sequence: Synthetic polypeptide
AEAEIGTTNPVATEGYGQCVCSNWGEDHNAENFNSDTQS

SEQ ID NO: 207898 - protein, 39 aa, Artificial Sequence
  Description of Artificial Sequence: Synthetic polypeptide
AEAEISTTNPVAYEQYGQCVCSNWVEDHNAENFNSETQQ

SEQ ID NO: 207899 - protein, 39 aa, Artificial Sequence
  Description of Artificial Sequence: Synthetic polypeptide
AEAEIRTTNPVATEQFGTCVCSNWGYDDNAEHFISDTQS

SEQ ID NO: 207900 - protein, 39 aa, Artificial Sequence
  Description of Artificial Sequence: Synthetic polypeptide
AEAEISTTNPVAYEQYGQCVCSNWGYDHNAENFNSDTQG

SEQ ID NO: 207901 - protein, 37 aa, Artificial Sequence
  Description of Artificial Sequence: Synthetic polypeptide
CEDVIATTNPVATEQWGCNCAGTGPHPGDNHPDDSNN

SEQ ID NO: 207902 - protein, 42 aa, Artificial Sequence
  Description of Artificial Sequence: Synthetic polypeptide
ADLEEVIMCTVERNPVAFEVYNGASLDSITDLLYGTRGSNDR

SEQ ID NO: 207903 - protein, 39 aa, Artificial Sequence
  Description of Artificial Sequence: Synthetic polypeptide
AEAEISTTNPVAYEQYGQCVCSNWGEDHNAENSNSDTQL

SEQ ID NO: 207904 - protein, 39 aa, Artificial Sequence
  Description of Artificial Sequence: Synthetic polypeptide
AEAEISTTNPVAYEQYGQCVCSNWGEDHNAENFPSDNQA

SEQ ID NO: 207905 - protein, 34 aa, Artificial Sequence
  Description of Artificial Sequence: Synthetic polypeptide
QEGEIACTNPCSYEQWGITCYCNDQQDHGDTVSQ

SEQ ID NO: 207906 - protein, 39 aa, Artificial Sequence
  Description of Artificial Sequence: Synthetic polypeptide
AEAEISTTNPVAYEQYGQCVCSNWEEDPNTEGFNSDTQS

SEQ ID NO: 207907 - protein, 39 aa, Artificial Sequence
  Description of Artificial Sequence: Synthetic polypeptide
DEAEISTTNPVAYEQYGQCVCGNWGPDHNAENFNSETQA

SEQ ID NO: 207908 - protein, 39 aa, Artificial Sequence
  Description of Artificial Sequence: Synthetic polypeptide
AEAEISTTNPVAYEQYGQCVCSNWEEDHNAEGFNSDTQF

SEQ ID NO: 207909 - protein, 40 aa, Artificial Sequence
  Description of Artificial Sequence: Synthetic polypeptide
AEAEISTTNPVATEGYGQCQVCSTWEEDHNAENFNSDTQN

SEQ ID NO: 207910 - protein, 39 aa, Artificial Sequence
  Description of Artificial Sequence: Synthetic polypeptide
AEAEISTTNPVAYEQYGQCVCSMWGEDHNAEYFNSETQA

SEQ ID NO: 207911 - protein, 39 aa, Artificial Sequence
  Description of Artificial Sequence: Synthetic polypeptide
DEDEIATTNPVATEQWGCCCTAGTGDHPGNNHPDDSFNN

SEQ ID NO: 207912 - protein, 40 aa, Artificial Sequence
  Description of Artificial Sequence: Synthetic polypeptide
DEMCISTTNPVATEQYGQCQVCSNWGEDHNAENFNSETQS

SEQ ID NO: 207913 - protein, 39 aa, Artificial Sequence
  Description of Artificial Sequence: Synthetic polypeptide
AEAEISTTNPVAYEQYGQCVCSMWGEDHNAENFNSDTQS

SEQ ID NO: 207914 - protein, 40 aa, Artificial Sequence
  Description of Artificial Sequence: Synthetic polypeptide
AEAEISTTNPVAYEQYGQCQVCSNSGEGTNAENFNSDFQS

SEQ ID NO: 207915 - protein, 40 aa, Artificial Sequence
  Description of Artificial Sequence: Synthetic polypeptide
AEAEISTTNPVATEGYGQCQVCSTWEEGHNAENFNSDTQS

SEQ ID NO: 207916 - protein, 39 aa, Artificial Sequence
  Description of Artificial Sequence: Synthetic polypeptide
AEAEISTTNPVATEGYGQCVCSMWMEDHNAENFNSDTQS

SEQ ID NO: 207917 - protein, 39 aa, Artificial Sequence
  Description of Artificial Sequence: Synthetic polypeptide
AEAEISTTNPVATEGYGQCVCSNSGEDDNAENFNSETQA

SEQ ID NO: 207918 - protein, 39 aa, Artificial Sequence
  Description of Artificial Sequence: Synthetic polypeptide
CEECISTTNPVATEQYGQCVCSNWGEDHNAESFPSDTQS

SEQ ID NO: 207919 - protein, 39 aa, Artificial Sequence
  Description of Artificial Sequence: Synthetic polypeptide
DEMCISTTNPVATEQYGQCVCPNWGEDHNAENFNSETQA

SEQ ID NO: 207920 - protein, 39 aa, Artificial Sequence
  Description of Artificial Sequence: Synthetic polypeptide
DEAEISTTNPVAYEQYGQCVCPNWGEDHNAENFNSDTQS

SEQ ID NO: 207921 - protein, 39 aa, Artificial Sequence
  Description of Artificial Sequence: Synthetic polypeptide
DESEIRTTNCVATEAYGAAGNGNGDENDGETQGGMEGAQ

SEQ ID NO: 207922 - protein, 39 aa, Artificial Sequence
  Description of Artificial Sequence: Synthetic polypeptide
AEAEISTTNPVAYEQYGQCVCSNWGEDDNAENFNSDNQS

SEQ ID NO: 207923 - protein, 39 aa, Artificial Sequence
  Description of Artificial Sequence: Synthetic polypeptide
AEAEISTTNPVAYEQYGQCVCSNWGEDDNAENFNSDTQS

SEQ ID NO: 207924 - protein, 39 aa, Artificial Sequence
  Description of Artificial Sequence: Synthetic polypeptide
DESEIRTTNCVATEAYGAAGNGAGDMNDGEQQGGPEGGQ

SEQ ID NO: 207925 - protein, 39 aa, Artificial Sequence
  Description of Artificial Sequence: Synthetic polypeptide
DEAEISTTNPVAYEQYGQCVCSMWGEDHNAENFISDTQA

SEQ ID NO: 207926 - protein, 39 aa, Artificial Sequence
  Description of Artificial Sequence: Synthetic polypeptide
DESEIRTTNCVATEAYGAAGNGAGDENDSEQQGGMEAAQ

SEQ ID NO: 207927 - protein, 38 aa, Artificial Sequence
  Description of Artificial Sequence: Synthetic polypeptide
AEAEISCTNPVATEQYGQCVCGNWMEHNAENFNSDNQS

SEQ ID NO: 207928 - protein, 39 aa, Artificial Sequence
  Description of Artificial Sequence: Synthetic polypeptide
DESEIRTTNCVATEAYGAAGNGAGDDNDGEQQGGMDGGE

SEQ ID NO: 207929 - protein, 38 aa, Artificial Sequence
  Description of Artificial Sequence: Synthetic polypeptide
DESEIRTTNCVATEAYGAAGNGAGDDNDEEEGGMEGAQ

SEQ ID NO: 207930 - protein, 39 aa, Artificial Sequence
  Description of Artificial Sequence: Synthetic polypeptide
DESEIRTTNCVATEAYGAAGDNAGDDTDGEQGGMEGAQQ

SEQ ID NO: 207931 - protein, 39 aa, Artificial Sequence
  Description of Artificial Sequence: Synthetic polypeptide
AEAEISTTNPVAYEQYGQCVCSNWGEDHNAENFNSDTQG

SEQ ID NO: 207932 - protein, 38 aa, Artificial Sequence
  Description of Artificial Sequence: Synthetic polypeptide
CEECISTTNPVAYEQWGQCVCSNWMEHNQENFNSDTQS

SEQ ID NO: 207933 - protein, 39 aa, Artificial Sequence
  Description of Artificial Sequence: Synthetic polypeptide
AEAEISTTNPVAYEQYGQCVCSNWGEDHNAENFNSDTQA

SEQ ID NO: 207934 - protein, 39 aa, Artificial Sequence
  Description of Artificial Sequence: Synthetic polypeptide
DEAEISTTNPVAYEQYGQCVCQNWGEDHNAEYFNSEFQA

SEQ ID NO: 207935 - protein, 39 aa, Artificial Sequence
  Description of Artificial Sequence: Synthetic polypeptide
DEAEISTTNPVAYEQYGQCVCQNWGEDHNAENFISDTQS

SEQ ID NO: 207936 - protein, 39 aa, Artificial Sequence
  Description of Artificial Sequence: Synthetic polypeptide
DEAEISTTNPVAYEQYGQCVCQNWEEDHNAENFISDNQS

SEQ ID NO: 207937 - protein, 38 aa, Artificial Sequence
  Description of Artificial Sequence: Synthetic polypeptide
AEAEISCTNPVAYEQYGQCVCSNWGEHNAENFISDNQS

SEQ ID NO: 207938 - protein, 38 aa, Artificial Sequence
  Description of Artificial Sequence: Synthetic polypeptide
AEAEISTTNPVATEGYGCTCSMWEEDDNAEYINSDTQA

SEQ ID NO: 207939 - protein, 38 aa, Artificial Sequence
  Description of Artificial Sequence: Synthetic polypeptide
CEECISTTNPVAYCQYGCVCSNWGEDHNAENFNSDTQA

SEQ ID NO: 207940 - protein, 39 aa, Artificial Sequence
  Description of Artificial Sequence: Synthetic polypeptide
DEAVIRTTNPVATEGYGQCVCENWGEDPNAEYFNSDNQA

SEQ ID NO: 207941 - protein, 37 aa, Artificial Sequence
  Description of Artificial Sequence: Synthetic polypeptide
DAEEIATTNPVAYASWGCNTAGNNGLVTTAELGNLDS

SEQ ID NO: 207942 - protein, 39 aa, Artificial Sequence
  Description of Artificial Sequence: Synthetic polypeptide
ADAEISTTNPVATEQYGQCVCSNWMEDDNTENFNSETQS

SEQ ID NO: 207943 - protein, 39 aa, Artificial Sequence
  Description of Artificial Sequence: Synthetic polypeptide
DEAVIGTTNPVATEQWGQCVCSNWGDDDNAEYFGSDTQA

SEQ ID NO: 207944 - protein, 39 aa, Artificial Sequence
  Description of Artificial Sequence: Synthetic polypeptide
DEAEISCTNPVAYEQYGQCVCSNWGEDHNAEGFNSDTQA

SEQ ID NO: 207945 - protein, 39 aa, Artificial Sequence
  Description of Artificial Sequence: Synthetic polypeptide
DEAEISCTNPVAYEQYGQCVCSNWGEDDNAENFNSDNQS

SEQ ID NO: 207946 - protein, 39 aa, Artificial Sequence
  Description of Artificial Sequence: Synthetic polypeptide
DEAEISCTNPVAYEQYGQCVCSDWGEDHNAENSNSENQA

SEQ ID NO: 207947 - protein, 39 aa, Artificial Sequence
  Description of Artificial Sequence: Synthetic polypeptide
DEAEISCTNPVAYEGYGQCVCSTWGEDHNAEYFNSENQA

SEQ ID NO: 207948 - protein, 36 aa, Artificial Sequence
  Description of Artificial Sequence: Synthetic polypeptide
DESEIRTTNPIATECWGATTCACAEDHAEPTGGPYI

SEQ ID NO: 207949 - protein, 39 aa, Artificial Sequence
  Description of Artificial Sequence: Synthetic polypeptide
AEECIRTTNPVAYEGYGQCVCSNWGEDHNAENFNSENQA

SEQ ID NO: 207950 - protein, 39 aa, Artificial Sequence
  Description of Artificial Sequence: Synthetic polypeptide
DEAEISTTNPVAYEGYGQCVCSNWGEDDNAENFNSDNQA

SEQ ID NO: 207951 - protein, 38 aa, Artificial Sequence
  Description of Artificial Sequence: Synthetic polypeptide
DEMCISTTNPVATEGYGQCVCQNWGAHNIENFMSDTQS

SEQ ID NO: 207952 - protein, 39 aa, Artificial Sequence
  Description of Artificial Sequence: Synthetic polypeptide
DEAEISCTNPVATEYYGQCVCSNWGEDHNAEFFNSETQQ

SEQ ID NO: 207953 - protein, 39 aa, Artificial Sequence
  Description of Artificial Sequence: Synthetic polypeptide
DEMCISTTNPVATEGYGQCVCSNWGEDHNAENFNSDNQL

SEQ ID NO: 207954 - protein, 38 aa, Artificial Sequence
  Description of Artificial Sequence: Synthetic polypeptide
DESEICTTNCVATEAYGAANNAAGDDNDGEQGGMEGAQ

SEQ ID NO: 207955 - protein, 39 aa, Artificial Sequence
  Description of Artificial Sequence: Synthetic polypeptide
AEECIRTTNPVAYEGYGQCVCSNWGEDHNAENFNSDNQL

SEQ ID NO: 207956 - protein, 40 aa, Artificial Sequence
  Description of Artificial Sequence: Synthetic polypeptide
DEAEISCTNPVATEQYGQCQVCSNWGEDDNIENFNSDNQS

SEQ ID NO: 207957 - protein, 36 aa, Artificial Sequence
  Description of Artificial Sequence: Synthetic polypeptide
DDSEVASTNPVSYEGYGNTVACNGTEISQSGTGGQR

SEQ ID NO: 207958 - protein, 39 aa, Artificial Sequence
  Description of Artificial Sequence: Synthetic polypeptide
DEAEISCTNPVAYEQYGQCVCSNWGEDHNAENFGSETQS

SEQ ID NO: 207959 - protein, 38 aa, Artificial Sequence
  Description of Artificial Sequence: Synthetic polypeptide
CEEEIACTNPVAYEQWGTCFVAATGEHADIGNSDESAM

SEQ ID NO: 207960 - protein, 39 aa, Artificial Sequence
  Description of Artificial Sequence: Synthetic polypeptide
DEAEISCTNPVAYEQYGQCVCSNWGEDHNAENFISDNQA

SEQ ID NO: 207961 - protein, 39 aa, Artificial Sequence
  Description of Artificial Sequence: Synthetic polypeptide
DEAEISCTNPVAYEQYGQCVCSNWGEDHNAENFNSETQA

SEQ ID NO: 207962 - protein, 39 aa, Artificial Sequence
  Description of Artificial Sequence: Synthetic polypeptide
AEECISTTNPVATEGYGQCSCSMWGEDHNAENFNSDTQS

SEQ ID NO: 207963 - protein, 39 aa, Artificial Sequence
  Description of Artificial Sequence: Synthetic polypeptide
AEECISTTNPVATEGYGQCVCSMWGEDHNTENFISDTQS

SEQ ID NO: 207964 - protein, 39 aa, Artificial Sequence
  Description of Artificial Sequence: Synthetic polypeptide
AEECISTTNPVATEGYGQCVCSNWEEDHNIENFISDNQA

SEQ ID NO: 207965 - protein, 39 aa, Artificial Sequence
  Description of Artificial Sequence: Synthetic polypeptide
AEECISTTNPVATEGYGQCVCSNWGEDDNTENFNSDTQS

SEQ ID NO: 207966 - protein, 39 aa, Artificial Sequence
  Description of Artificial Sequence: Synthetic polypeptide
AEECISTTNPVATEGYGQCVCSNWGEDHNAENFISDNQA

SEQ ID NO: 207967 - protein, 39 aa, Artificial Sequence
  Description of Artificial Sequence: Synthetic polypeptide
AEECISTTNPVATEGYGQCVCSNWGEDHNAENFNSDTQA

SEQ ID NO: 207968 - protein, 37 aa, Artificial Sequence
  Description of Artificial Sequence: Synthetic polypeptide
CEDEIATTNPVAYAAWGCTASSATAGDQTAGGPNGFN

SEQ ID NO: 207969 - protein, 39 aa, Artificial Sequence
  Description of Artificial Sequence: Synthetic polypeptide
AEECISTTNPVATEGYGQCVCSNWGEDHNAENFNSDTQF

SEQ ID NO: 207970 - protein, 39 aa, Artificial Sequence
  Description of Artificial Sequence: Synthetic polypeptide
DEAEISTTNPCATEGYGQCVCSNWGEDHNAENFNSDNQS

SEQ ID NO: 207971 - protein, 39 aa, Artificial Sequence
  Description of Artificial Sequence: Synthetic polypeptide
AEECISTTNPVATEGYGQCVCSNWGEDHNAENFNSQTQA

SEQ ID NO: 207972 - protein, 39 aa, Artificial Sequence
  Description of Artificial Sequence: Synthetic polypeptide
AEECISTTNPVATEGYGQCVCSNWGEGHNAENFNSDTQA

SEQ ID NO: 207973 - protein, 38 aa, Artificial Sequence
  Description of Artificial Sequence: Synthetic polypeptide
DEMEIRTTNPCATEGWGCQTCQNWMEDNAENSGSDNQA

SEQ ID NO: 207974 - protein, 39 aa, Artificial Sequence
  Description of Artificial Sequence: Synthetic polypeptide
DEAEISTTNPVAYEGYGQCVCSNWEEDHNAEFFNSDNQS

SEQ ID NO: 207975 - protein, 39 aa, Artificial Sequence
  Description of Artificial Sequence: Synthetic polypeptide
DEAEISTTNPVAYEGYGQCVCSNWEEDHNAEHFNSDPQG

SEQ ID NO: 207976 - protein, 39 aa, Artificial Sequence
  Description of Artificial Sequence: Synthetic polypeptide
DEAEISTTNPVAYEGYGQCVCSNWGEDDNAEGFNSENQA

SEQ ID NO: 207977 - protein, 39 aa, Artificial Sequence
  Description of Artificial Sequence: Synthetic polypeptide
DEAEISCTNPVAYEQYGQCVCSNWGEDHNAENFNSDTQS

SEQ ID NO: 207978 - protein, 39 aa, Artificial Sequence
  Description of Artificial Sequence: Synthetic polypeptide
DEMAISTTNPVAYEQYGQCVCSNWMEDHNAENFNSETQA

SEQ ID NO: 207979 - protein, 38 aa, Artificial Sequence
  Description of Artificial Sequence: Synthetic polypeptide
DEMCISTTNPVATEQWGQCVCSNSGEHNAEYSISDTAS

SEQ ID NO: 207980 - protein, 39 aa, Artificial Sequence
  Description of Artificial Sequence: Synthetic polypeptide
DEAEISCTNPVATEGYGQCVCSNWGEDPNAENFNSETQA

SEQ ID NO: 207981 - protein, 38 aa, Artificial Sequence
  Description of Artificial Sequence: Synthetic polypeptide
DEAEIRTTNPVSTEGYGCICSNWEEDDNAEGFISDTQS

SEQ ID NO: 207982 - protein, 39 aa, Artificial Sequence
  Description of Artificial Sequence: Synthetic polypeptide
DEAEISTTNPVAYEGYGQCVCSNWGEDHNAESFNSDTQS

SEQ ID NO: 207983 - protein, 39 aa, Artificial Sequence
  Description of Artificial Sequence: Synthetic polypeptide
DEAEISTTNPVAYEGYGQCVCSNWGEDHNIESFNSDNQS

SEQ ID NO: 207984 - protein, 39 aa, Artificial Sequence
  Description of Artificial Sequence: Synthetic polypeptide
DEAEISTTNPVAYEGYGQCVCSNWGEDHNQENFNSDNQS

SEQ ID NO: 207985 - protein, 38 aa, Artificial Sequence
  Description of Artificial Sequence: Synthetic polypeptide
AEAAISTTNPVAYEQYGCVCSNWGEDHNAEGFNSDTQA

SEQ ID NO: 207986 - protein, 39 aa, Artificial Sequence
  Description of Artificial Sequence: Synthetic polypeptide
ADMEISTTNPVAYEQYGQCVCSTWGEEHNAENFNSDNQA

SEQ ID NO: 207987 - protein, 39 aa, Artificial Sequence
  Description of Artificial Sequence: Synthetic polypeptide
ADMEISTTNPVAYEQYGQCVCSTWGEDHNAEYFNSENQA

SEQ ID NO: 207988 - protein, 39 aa, Artificial Sequence
  Description of Artificial Sequence: Synthetic polypeptide
DEAEISTTNPVAYEGYGQCVCSNWGEDHNTEYFNSDFQA

SEQ ID NO: 207989 - protein, 39 aa, Artificial Sequence
  Description of Artificial Sequence: Synthetic polypeptide
DEAEISTTNPVAYEGYGQCVCSNWGEDPNAENFISENQS

SEQ ID NO: 207990 - protein, 36 aa, Artificial Sequence
  Description of Artificial Sequence: Synthetic polypeptide
CEEEIATTNPVAYMAYGEHAPWCEHAFSQSHAEGEW

SEQ ID NO: 207991 - protein, 39 aa, Artificial Sequence
  Description of Artificial Sequence: Synthetic polypeptide
DEAEISTTNPVAYEGYGQCVCSNWGEGHNAENFNSDTQP

SEQ ID NO: 207992 - protein, 39 aa, Artificial Sequence
  Description of Artificial Sequence: Synthetic polypeptide
ADMEIRTTNPVAYEQYGQCVCSNWGEDHNIESFNSETQS

SEQ ID NO: 207993 - protein, 38 aa, Artificial Sequence
  Description of Artificial Sequence: Synthetic polypeptide
DEDCIACTNPVATEQWGHSWCSAMWPAGTNPGNPMEPV

SEQ ID NO: 207994 - protein, 35 aa, Artificial Sequence
  Description of Artificial Sequence: Synthetic polypeptide
DESEIATTNPIGTECWGATTWANAEDWAEPKGPYI

SEQ ID NO: 207995 - protein, 38 aa, Artificial Sequence
  Description of Artificial Sequence: Synthetic polypeptide
DEMCIRTTNPLATEGWGQCVCSNWGEHNQESFGSDTQA

SEQ ID NO: 207996 - protein, 39 aa, Artificial Sequence
  Description of Artificial Sequence: Synthetic polypeptide
DEAEISTTNPVAYEGYGQCVCSNWGEDHNAENFNSETQS

SEQ ID NO: 207997 - protein, 35 aa, Artificial Sequence
  Description of Artificial Sequence: Synthetic polypeptide
VETEIATTNPIATECWGATYYANENDQHEKTMKTM

SEQ ID NO: 207998 - protein, 39 aa, Artificial Sequence
  Description of Artificial Sequence: Synthetic polypeptide
DERCISTTNPVATEEWGQCVCSNWGEDHNTENFNSDNQA

SEQ ID NO: 207999 - protein, 39 aa, Artificial Sequence
  Description of Artificial Sequence: Synthetic polypeptide
DEAEISTTNPVAYEQYGQCVCSNWEEDHNAENFISDTQS

SEQ ID NO: 208000 - protein, 38 aa, Artificial Sequence
  Description of Artificial Sequence: Synthetic polypeptide
YENEIRTTNCAATEQYGMIGVQDDDDEMDNGGGGQEQD

SEQ ID NO: 208001 - protein, 34 aa, Artificial Sequence
  Description of Artificial Sequence: Synthetic polypeptide
QEGEIACTNPCSYEQWGITCYCNDQQDQADTVRE

SEQ ID NO: 208002 - protein, 39 aa, Artificial Sequence
  Description of Artificial Sequence: Synthetic polypeptide
DEAEISCTNPVATEGYGQCVCSNWGEDHNTEGFNSDTQA

SEQ ID NO: 208003 - protein, 39 aa, Artificial Sequence
  Description of Artificial Sequence: Synthetic polypeptide
DEAEISTTNPVAYEGYGQCVCSNWGEDDNAENFNSDTQS

SEQ ID NO: 208004 - protein, 39 aa, Artificial Sequence
  Description of Artificial Sequence: Synthetic polypeptide
DEAEISTTNPVAYEGYGQCVCSNWGEDHNAEFFPSDNQS

SEQ ID NO: 208005 - protein, 39 aa, Artificial Sequence
  Description of Artificial Sequence: Synthetic polypeptide
DEAEISTTNPVAYEGYGQCVCSNWGEDHNAEGFNSDTQA

SEQ ID NO: 208006 - protein, 39 aa, Artificial Sequence
  Description of Artificial Sequence: Synthetic polypeptide
DEAEISCTNPVATEGYGQCVCSNWGEDHNAENFNSDTQQ

SEQ ID NO: 208007 - protein, 39 aa, Artificial Sequence
  Description of Artificial Sequence: Synthetic polypeptide
DEAEISCTNPVATEEYGQCVCSNWGEDHNAENFNSDTQA

SEQ ID NO: 208008 - protein, 39 aa, Artificial Sequence
  Description of Artificial Sequence: Synthetic polypeptide
DEAEISCTNPVATEEYGQCVCSNSGEDHNAENFISDNQA

SEQ ID NO: 208009 - protein, 39 aa, Artificial Sequence
  Description of Artificial Sequence: Synthetic polypeptide
DEAEISTTNPVAYEGYGQCVCSNWGEDHNAEHFNSDTQA

SEQ ID NO: 208010 - protein, 34 aa, Artificial Sequence
  Description of Artificial Sequence: Synthetic polypeptide
QEGEIACTNPCSYEQWGITCYCNDQQDHQDTQRE

SEQ ID NO: 208011 - protein, 34 aa, Artificial Sequence
  Description of Artificial Sequence: Synthetic polypeptide
QEGEIACTNPCSYEQWGITCYCNDQQDHGKTQDN

SEQ ID NO: 208012 - protein, 39 aa, Artificial Sequence
  Description of Artificial Sequence: Synthetic polypeptide
DEAEISTTNPVAYEGYGQCVCSNWGEDHNAENFISDNQN

SEQ ID NO: 208013 - protein, 39 aa, Artificial Sequence
  Description of Artificial Sequence: Synthetic polypeptide
DEAEISTTNPVAYEGYGQCVCSNWGEDHNAENFNSDTQA

SEQ ID NO: 208014 - protein, 39 aa, Artificial Sequence
  Description of Artificial Sequence: Synthetic polypeptide
DEAEIRTTNPVAYEGYGQCVCGNWGEDHNAENFNSETQS

SEQ ID NO: 208015 - protein, 38 aa, Artificial Sequence
  Description of Artificial Sequence: Synthetic polypeptide
CEEEIACTNPVATEQYGCACGAGGGHQVPAAGGDIEDD

SEQ ID NO: 208016 - protein, 39 aa, Artificial Sequence
  Description of Artificial Sequence: Synthetic polypeptide
DEAEISTTNPVATEQYGQCVCQMWGEDHNEEFFISDTQA

SEQ ID NO: 208017 - protein, 38 aa, Artificial Sequence
  Description of Artificial Sequence: Synthetic polypeptide
AENEISTTNPCATEQYGCVCQNWGEDHNAENFNSDNQS

SEQ ID NO: 208018 - protein, 39 aa, Artificial Sequence
  Description of Artificial Sequence: Synthetic polypeptide
DDEEISTTNPVAYEGYGQCVCSNSGEDDNAENFNSDTQM

SEQ ID NO: 208019 - protein, 39 aa, Artificial Sequence
  Description of Artificial Sequence: Synthetic polypeptide
SEEEISTTNPVAYEEYGQCVCSNWGEDHNAENFNSDNQA

SEQ ID NO: 208020 - protein, 37 aa, Artificial Sequence
  Description of Artificial Sequence: Synthetic polypeptide
SEATTEIATTNPVAYEPWGAVCIENHMEQNQHGIHHG

SEQ ID NO: 208021 - protein, 39 aa, Artificial Sequence
  Description of Artificial Sequence: Synthetic polypeptide
SEEEISTTNPVAYEGYGQCQVCSNWGEHNAENFNSDNQG

SEQ ID NO: 208022 - protein, 40 aa, Artificial Sequence
  Description of Artificial Sequence: Synthetic polypeptide
SEEEISTTNPVAYEGYGQCQVCSTWGEDHNAENSNSDNQS

SEQ ID NO: 208023 - protein, 39 aa, Artificial Sequence
  Description of Artificial Sequence: Synthetic polypeptide
SEEEISTTNPVAYEGYGQCVCSNSEEDHNAENFNSQNQA

SEQ ID NO: 208024 - protein, 39 aa, Artificial Sequence
  Description of Artificial Sequence: Synthetic polypeptide
SEEEISTTNPVAYEGYGQCVCSNWEEPHNAENFNSDTQL

SEQ ID NO: 208025 - protein, 39 aa, Artificial Sequence
  Description of Artificial Sequence: Synthetic polypeptide
SEEEISTTNPVAYEGYGQCVCSNWGEDDNAENFNSDNQS

SEQ ID NO: 208026 - protein, 39 aa, Artificial Sequence
  Description of Artificial Sequence: Synthetic polypeptide
SEEEISTTNPVAYEGYGQCVCSNWGEDHNAEHFNSDTQS

SEQ ID NO: 208027 - protein, 39 aa, Artificial Sequence
  Description of Artificial Sequence: Synthetic polypeptide
SEEEISTTNPVAYEGYGQCVCSNWGEDHNAENFNSDNQS

SEQ ID NO: 208028 - protein, 38 aa, Artificial Sequence
  Description of Artificial Sequence: Synthetic polypeptide
SEEEISTTNPVAYEEYGCVCGNWGEDHNAENFNSDNQA

SEQ ID NO: 208029 - protein, 39 aa, Artificial Sequence
  Description of Artificial Sequence: Synthetic polypeptide
SEEEISTTNPVAYEGYGQCVCSNWGEDHNAENFNSDTQS

SEQ ID NO: 208030 - protein, 39 aa, Artificial Sequence
  Description of Artificial Sequence: Synthetic polypeptide
SEEEISTTNPVAYEGYGQCVCSNWGEDHNTEGFNSDTQS

SEQ ID NO: 208031 - protein, 39 aa, Artificial Sequence
  Description of Artificial Sequence: Synthetic polypeptide
SEEEISTTNPVAYEGYGQCVCSNWGEDHNTENFISDTQA

SEQ ID NO: 208032 - protein, 38 aa, Artificial Sequence
  Description of Artificial Sequence: Synthetic polypeptide
SEEEISTTNPVAYEGYGQCVCSNWGEDNAEYFISDTQS

SEQ ID NO: 208033 - protein, 39 aa, Artificial Sequence
  Description of Artificial Sequence: Synthetic polypeptide
SEEEISTTNPVAYEGYGQCVCSNWGEGHNAENFNSDNQA

SEQ ID NO: 208034 - protein, 39 aa, Artificial Sequence
  Description of Artificial Sequence: Synthetic polypeptide
SEEEISTTNPVAYEGYGQCVCSNWMEDHNAENFNSDTQS

SEQ ID NO: 208035 - protein, 40 aa, Artificial Sequence
  Description of Artificial Sequence: Synthetic polypeptide
SEEEISTTNPVAYEQYGQCAVCSNWGEDHNAEYFNSETQS

SEQ ID NO: 208036 - protein, 39 aa, Artificial Sequence
  Description of Artificial Sequence: Synthetic polypeptide
SEEEISTTNPVAYEQYGQCICSNWGEDHNTEGFNSDTQA

SEQ ID NO: 208037 - protein, 39 aa, Artificial Sequence
  Description of Artificial Sequence: Synthetic polypeptide
SEEEISTTNPVAYEQYGQCVCFNWGEDHNAENFNSETQS

SEQ ID NO: 208038 - protein, 39 aa, Artificial Sequence
  Description of Artificial Sequence: Synthetic polypeptide
SEEEISTTNPVAYEQYGQCVCGNWEEDHNAENFNSDNQM

SEQ ID NO: 208039 - protein, 39 aa, Artificial Sequence
  Description of Artificial Sequence: Synthetic polypeptide
SEEEISTTNPVAYEGYGQCVCSNWGEDHNAENFNSETQF

SEQ ID NO: 208040 - protein, 39 aa, Artificial Sequence
  Description of Artificial Sequence: Synthetic polypeptide
SEEEISTTNPVAYEQYGQCVCGNWGEDDNAENFNSDNQS

SEQ ID NO: 208041 - protein, 40 aa, Artificial Sequence
  Description of Artificial Sequence: Synthetic polypeptide
SEEEISTTNPVATEQYGQCQVCGNWGEDHNAEHFNSETQA

SEQ ID NO: 208042 - protein, 38 aa, Artificial Sequence
  Description of Artificial Sequence: Synthetic polypeptide
SECAEIATTNPVAYEAWGVCVQWETNNDTERPGGGGQM

SEQ ID NO: 208043 - protein, 39 aa, Artificial Sequence
  Description of Artificial Sequence: Synthetic polypeptide
DDACISTTNPVATEQYGQCVCSNWMEDHNAENFNSDTQS

SEQ ID NO: 208044 - protein, 39 aa, Artificial Sequence
  Description of Artificial Sequence: Synthetic polypeptide
DDACISTTNPVATEQYGQCVCSNWGPDHNAENFNSDTQQ

SEQ ID NO: 208045 - protein, 39 aa, Artificial Sequence
  Description of Artificial Sequence: Synthetic polypeptide
DDACISTTNPVATEQYGQCVCSNWGEDHNAENFNSDTQS

SEQ ID NO: 208046 - protein, 39 aa, Artificial Sequence
  Description of Artificial Sequence: Synthetic polypeptide
DDACISTTNPVATEQYGQCVCSNWGEDHNAEFFNSDTQG

SEQ ID NO: 208047 - protein, 39 aa, Artificial Sequence
  Description of Artificial Sequence: Synthetic polypeptide
DDACISTTNPVATEQYGQCVCSNWGEDDNAENFNSDNQA

SEQ ID NO: 208048 - protein, 39 aa, Artificial Sequence
  Description of Artificial Sequence: Synthetic polypeptide
DEVEIATTNPVATEQWGCTNNQANANNVDTATASDEGWP

SEQ ID NO: 208049 - protein, 39 aa, Artificial Sequence
  Description of Artificial Sequence: Synthetic polypeptide
DDACISTTNPVATEQYGQCVCSNWEEDHNAEGFNSDTQF

SEQ ID NO: 208050 - protein, 39 aa, Artificial Sequence
  Description of Artificial Sequence: Synthetic polypeptide
SECAEIATTNPVAYEQWGVCVQWETVNNDTNRPGGGHAM

SEQ ID NO: 208051 - protein, 39 aa, Artificial Sequence
  Description of Artificial Sequence: Synthetic polypeptide
SEEEISCTNPVATEEYGQCVCSNWGEDHNAENFNSDTQL

SEQ ID NO: 208052 - protein, 39 aa, Artificial Sequence
  Description of Artificial Sequence: Synthetic polypeptide
DDACISTTNPVATEQYGQCQVCSNSGEHNAENFNSDTQG

SEQ ID NO: 208053 - protein, 39 aa, Artificial Sequence
  Description of Artificial Sequence: Synthetic polypeptide
SEEEISCTNPVATEGYGQCVCSNWGEDHNAENFNSDTQA

SEQ ID NO: 208054 - protein, 39 aa, Artificial Sequence
  Description of Artificial Sequence: Synthetic polypeptide
SECAEIATTNPVAYEQWGVCVQWETNVNDTNRSGGGHSM

SEQ ID NO: 208055 - protein, 38 aa, Artificial Sequence
  Description of Artificial Sequence: Synthetic polypeptide
SEEEISCTNPVAYEGYGQCVCSNWGEHNAENFNSETQA

SEQ ID NO: 208056 - protein, 40 aa, Artificial Sequence
  Description of Artificial Sequence: Synthetic polypeptide
SEEEISTTNPVATEAYGQCQVCSNWGEDHNAENFNSETQS

SEQ ID NO: 208057 - protein, 39 aa, Artificial Sequence
  Description of Artificial Sequence: Synthetic polypeptide
SEEEISTTNPVATEGYGQCVCENWGEDHNAENFNSDNQA

SEQ ID NO: 208058 - protein, 39 aa, Artificial Sequence
  Description of Artificial Sequence: Synthetic polypeptide
SEEEISTTNPVATEGYGQCVCGNWGEDHNAENFNSDTQA

SEQ ID NO: 208059 - protein, 39 aa, Artificial Sequence
  Description of Artificial Sequence: Synthetic polypeptide
SEEEISTTNPVATEGYGQCVCPNWGEDHEAESFNSDNQA

SEQ ID NO: 208060 - protein, 38 aa, Artificial Sequence
  Description of Artificial Sequence: Synthetic polypeptide
AENEIATTNPVAYEGYGCVCSTWGEDHNQEHFISETQA

SEQ ID NO: 208061 - protein, 39 aa, Artificial Sequence
  Description of Artificial Sequence: Synthetic polypeptide
SECAEIATTNPVAYEQWGVCAQWETNVNDTNRPGGGHRT

SEQ ID NO: 208062 - protein, 39 aa, Artificial Sequence
  Description of Artificial Sequence: Synthetic polypeptide
DDACISTTNPVATEQYGQCVCSNSGEDDNAENFNSDNQM

SEQ ID NO: 208063 - protein, 39 aa, Artificial Sequence
  Description of Artificial Sequence: Synthetic polypeptide
SEEEISCTNPVATEGYGQCVCSNWGEDHNAENFNSDTQS

SEQ ID NO: 208064 - protein, 39 aa, Artificial Sequence
  Description of Artificial Sequence: Synthetic polypeptide
DEECISCTNPVATEQYGQCVCGNWMEDHNAENFNSDNQS

SEQ ID NO: 208065 - protein, 39 aa, Artificial Sequence
  Description of Artificial Sequence: Synthetic polypeptide
SEEEISTTNPVAYEQYGQCVCPNWGEDHNAENFNSDNQA

SEQ ID NO: 208066 - protein, 38 aa, Artificial Sequence
  Description of Artificial Sequence: Synthetic polypeptide
DDACISTTNPVATEQYGCVCSNWGEDHNAENFISETQS

SEQ ID NO: 208067 - protein, 39 aa, Artificial Sequence
  Description of Artificial Sequence: Synthetic polypeptide
SEAEISTTNPVATEGYGQCVCSNWEEDHNAEGFNSDTQA

SEQ ID NO: 208068 - protein, 39 aa, Artificial Sequence
  Description of Artificial Sequence: Synthetic polypeptide
SEAEISTTNPVATEGYGQCVCSNSEEDHNQEHFNSDNQA

SEQ ID NO: 208069 - protein, 39 aa, Artificial Sequence
  Description of Artificial Sequence: Synthetic polypeptide
SEAEISTTNPVATEGYGQCVCSDWGEDHNAENFNSENQA

SEQ ID NO: 208070 - protein, 39 aa, Artificial Sequence
  Description of Artificial Sequence: Synthetic polypeptide
SEAEISTTNPVATEGYGQCVCQNSGEDHNAENFISDNQA

SEQ ID NO: 208071 - protein, 38 aa, Artificial Sequence
  Description of Artificial Sequence: Synthetic polypeptide
SEAEISCTNPVATEQYGCQVCENWGEHNAEHFGSDTQS

SEQ ID NO: 208072 - protein, 39 aa, Artificial Sequence
  Description of Artificial Sequence: Synthetic polypeptide
AEEEISTTNPVAYEAYGQCVCSNWGEDHNAENFNSETAA

SEQ ID NO: 208073 - protein, 39 aa, Artificial Sequence
  Description of Artificial Sequence: Synthetic polypeptide
AEEEISTTNPVAYEAYGQCVCSNWGEDHNAENFNSDTQA

SEQ ID NO: 208074 - protein, 39 aa, Artificial Sequence
  Description of Artificial Sequence: Synthetic polypeptide
DEECISCTNPVAYEGYGCIVCSNWGEDHNTENFNSENQA

SEQ ID NO: 208075 - protein, 39 aa, Artificial Sequence
  Description of Artificial Sequence: Synthetic polypeptide
DEECISCTNPVAYEGYGQCVCSNWGELHNAEGFNSDNQP

SEQ ID NO: 208076 - protein, 39 aa, Artificial Sequence
  Description of Artificial Sequence: Synthetic polypeptide
SEAEISTTNPVATEGYGQCVCSNWGEDHNAENFNSDTQA

SEQ ID NO: 208077 - protein, 38 aa, Artificial Sequence
  Description of Artificial Sequence: Synthetic polypeptide
EIEEIATTNPVAYEQWGVVCYQVTTNEHNQTQIDTDGE

SEQ ID NO: 208078 - protein, 39 aa, Artificial Sequence
  Description of Artificial Sequence: Synthetic polypeptide
DEECISCTNPVAYEQYGQCVCSMWGEDHNAENFNSDTQA

SEQ ID NO: 208079 - protein, 35 aa, Artificial Sequence
  Description of Artificial Sequence: Synthetic polypeptide
SEMEIACTNPCSYEAYGCVCSWGEHNQSFGSDTQA

SEQ ID NO: 208080 - protein, 39 aa, Artificial Sequence
  Description of Artificial Sequence: Synthetic polypeptide
DEECISCTNPVAYEQYGQCVCSNWGEDHNAEGFNSDTQP

SEQ ID NO: 208081 - protein, 37 aa, Artificial Sequence
  Description of Artificial Sequence: Synthetic polypeptide
SEMEIACTNPCSYEQYGCQVCSNWGEDNQSFGSDNQS

SEQ ID NO: 208082 - protein, 39 aa, Artificial Sequence
  Description of Artificial Sequence: Synthetic polypeptide
DEECISCTNPVAYEQYGQCVCSNWGEDHNAEYFNSETQA

SEQ ID NO: 208083 - protein, 39 aa, Artificial Sequence
  Description of Artificial Sequence: Synthetic polypeptide
DEECISCTNPVAYEQYGQCVCSNWGELHNAENFNSDNQG

SEQ ID NO: 208084 - protein, 38 aa, Artificial Sequence
  Description of Artificial Sequence: Synthetic polypeptide
DEEVIACTNPVAYEQWGCPVIAETGGGDNSAEGIGALM

SEQ ID NO: 208085 - protein, 37 aa, Artificial Sequence
  Description of Artificial Sequence: Synthetic polypeptide
SEMEIACTNPCSYEQYGCVCSMWGETNAESFGSDTQA

SEQ ID NO: 208086 - protein, 37 aa, Artificial Sequence
  Description of Artificial Sequence: Synthetic polypeptide
SEMEIACTNPCSYEQYGCVCSMWMEDNQESFGSDNQA

SEQ ID NO: 208087 - protein, 38 aa, Artificial Sequence
  Description of Artificial Sequence: Synthetic polypeptide
EIEEIATTNPVAYEQWGVVCYQVVTNEHNNTRDDTDGE

SEQ ID NO: 208088 - protein, 39 aa, Artificial Sequence
  Description of Artificial Sequence: Synthetic polypeptide
SEEEISTTNPVAYEQYGQCVCQMWGEDHNAEFFNSDPQS

SEQ ID NO: 208089 - protein, 35 aa, Artificial Sequence
  Description of Artificial Sequence: Synthetic polypeptide
SEMCIACTNPCSYEQYGCVCSWGEDNIESFGSDQS

SEQ ID NO: 208090 - protein, 39 aa, Artificial Sequence
  Description of Artificial Sequence: Synthetic polypeptide
SEAEISTTNPVAYEGYGQCVCSNWEEDHNAENFGSDNQS

SEQ ID NO: 208091 - protein, 39 aa, Artificial Sequence
  Description of Artificial Sequence: Synthetic polypeptide
DDACISTTNPVATEGYGQCVCSTWGEDDNAENFNSDTQP

SEQ ID NO: 208092 - protein, 36 aa, Artificial Sequence
  Description of Artificial Sequence: Synthetic polypeptide
DETTIRTTNPIATECWGATTWANAEDWAEPKGSPYI

SEQ ID NO: 208093 - protein, 36 aa, Artificial Sequence
  Description of Artificial Sequence: Synthetic polypeptide
DETSIRTTNPIATECWGATTWANAEDWMAEPKGPYI

SEQ ID NO: 208094 - protein, 38 aa, Artificial Sequence
  Description of Artificial Sequence: Synthetic polypeptide
DDACISTTNPVATEGYGQCVCSNWGEHNAENFNSDTQA

SEQ ID NO: 208095 - protein, 35 aa, Artificial Sequence
  Description of Artificial Sequence: Synthetic polypeptide
DETMIRTTNPIAYECWGATTWANAEDWAEPKGPYI

SEQ ID NO: 208096 - protein, 36 aa, Artificial Sequence
  Description of Artificial Sequence: Synthetic polypeptide
DETHIRTTNPIATECWGATTWANAEDWAEPKGPYIK

SEQ ID NO: 208097 - protein, 36 aa, Artificial Sequence
  Description of Artificial Sequence: Synthetic polypeptide
DETHIRTTNPIATECWGATTWANAEDWAEPKGPPYI

SEQ ID NO: 208098 - protein, 39 aa, Artificial Sequence
  Description of Artificial Sequence: Synthetic polypeptide
SEAEISTTNPVAYEYYGQCVCSNWGEDHNAENFQSENQA

SEQ ID NO: 208099 - protein, 39 aa, Artificial Sequence
  Description of Artificial Sequence: Synthetic polypeptide
SEAEISTTNPVAYEQYGQCVCSNWGEDHNIENFNSDTQS

SEQ ID NO: 208100 - protein, 37 aa, Artificial Sequence
  Description of Artificial Sequence: Synthetic polypeptide
DETEISTTNPCATEGWGCQTCFNAEEDAENSGSDNQS

SEQ ID NO: 208101 - protein, 35 aa, Artificial Sequence
  Description of Artificial Sequence: Synthetic polypeptide
DETEVASTNPIATEGWGNTTWAANEDIQEPVGPYI

SEQ ID NO: 208102 - protein, 39 aa, Artificial Sequence
  Description of Artificial Sequence: Synthetic polypeptide
SEAEISTTNPVAYEQYGQCVCSNWEEDHNAENFNSDTQG

SEQ ID NO: 208103 - protein, 39 aa, Artificial Sequence
  Description of Artificial Sequence: Synthetic polypeptide
SEAEISTTNPVAYEQYGQCVCGNSGEDDNAENFNSDTQS

SEQ ID NO: 208104 - protein, 36 aa, Artificial Sequence
  Description of Artificial Sequence: Synthetic polypeptide
DETELRTTNPIATECWGATTWANAEDWAEPKGPYIV

SEQ ID NO: 208105 - protein, 35 aa, Artificial Sequence
  Description of Artificial Sequence: Synthetic polypeptide
DETEIWTTNPIATECWGATTWAFAEDWAEPKGPYI

SEQ ID NO: 208106 - protein, 39 aa, Artificial Sequence
  Description of Artificial Sequence: Synthetic polypeptide
DDACISTTNPVATEGYGQCVCSNWEEDTNAENFNSDTQQ

SEQ ID NO: 208107 - protein, 40 aa, Artificial Sequence
  Description of Artificial Sequence: Synthetic polypeptide
SEAEISTTNPVAYEQYGQCQVCSTWEEDHNAENFNSDTQN

SEQ ID NO: 208108 - protein, 38 aa, Artificial Sequence
  Description of Artificial Sequence: Synthetic polypeptide
DDACISTTNPVATEGYGQCVCSMWGEHNAEFFNSQNQS

SEQ ID NO: 208109 - protein, 39 aa, Artificial Sequence
  Description of Artificial Sequence: Synthetic polypeptide
SEAEISTTNPVAYEQYGCQVCSNWGEDHNTENFNSETQA

SEQ ID NO: 208110 - protein, 39 aa, Artificial Sequence
  Description of Artificial Sequence: Synthetic polypeptide
SEAEISTTNPVAYEGYGQCVCSNWGEDHNTENFNSDNQN

SEQ ID NO: 208111 - protein, 39 aa, Artificial Sequence
  Description of Artificial Sequence: Synthetic polypeptide
SEAEISTTNPVAYEQYGQCVCSNWGEDDNTENFNSDTQS

SEQ ID NO: 208112 - protein, 37 aa, Artificial Sequence
  Description of Artificial Sequence: Synthetic polypeptide
SEMEIACTNPCSYEQYGCVCSNWENHNQESFGSDTQA

SEQ ID NO: 208113 - protein, 39 aa, Artificial Sequence
  Description of Artificial Sequence: Synthetic polypeptide
DEECISCTNPVATEQYGQCICSNWGEDHNAEFFNSDTQS

SEQ ID NO: 208114 - protein, 38 aa, Artificial Sequence
  Description of Artificial Sequence: Synthetic polypeptide
AENEIATTNPVATEGYGQCVCSWGEDHNQEHFISETLA

SEQ ID NO: 208115 - protein, 39 aa, Artificial Sequence
  Description of Artificial Sequence: Synthetic polypeptide
DEMEISTTNPCAYEQYGQCVCSNWGEDHNAENFNSETQA

SEQ ID NO: 208116 - protein, 40 aa, Artificial Sequence
  Description of Artificial Sequence: Synthetic polypeptide
DEEEISTTNPVAYEEYGQCQVCSNWGEDHNEENFNSDTQS

SEQ ID NO: 208117 - protein, 39 aa, Artificial Sequence
  Description of Artificial Sequence: Synthetic polypeptide
DEEEISTTNPVAYEEYGQCQVCGNWGEHNEEFFNSDTQS

SEQ ID NO: 208118 - protein, 39 aa, Artificial Sequence
  Description of Artificial Sequence: Synthetic polypeptide
DEACISCTNPVATEQYGQCVCSNWMEDHNAENFNSDTQS

SEQ ID NO: 208119 - protein, 39 aa, Artificial Sequence
  Description of Artificial Sequence: Synthetic polypeptide
DEEEISTTNPVAYCGYGQCVCSNWGEDHNTENFNSDTQA

SEQ ID NO: 208120 - protein, 39 aa, Artificial Sequence
  Description of Artificial Sequence: Synthetic polypeptide
DEACISCTNPVATEQYGQCVCSNWGEDHNAENFNSETQA

SEQ ID NO: 208121 - protein, 39 aa, Artificial Sequence
  Description of Artificial Sequence: Synthetic polypeptide
DEACISCTNPVATEQYGQCVCSNWGEDHNAEGFNSENQA

SEQ ID NO: 208122 - protein, 39 aa, Artificial Sequence
  Description of Artificial Sequence: Synthetic polypeptide
DDECISTTNPVATEQYGQCVCSNWEEDHNIENFISDPQA

SEQ ID NO: 208123 - protein, 39 aa, Artificial Sequence
  Description of Artificial Sequence: Synthetic polypeptide
DEACISCTNPVATEGYGQCVCSNWGEDTNAENFNSDTQA

SEQ ID NO: 208124 - protein, 38 aa, Artificial Sequence
  Description of Artificial Sequence: Synthetic polypeptide
DDAEIRTTNPVAYEGYGCCCSNWGEDHNAEHFGSDTQA

SEQ ID NO: 208125 - protein, 39 aa, Artificial Sequence
  Description of Artificial Sequence: Synthetic polypeptide
SEECISTTNPVATEGYGQCVCSNWGEDHNAENFNSDPQS

SEQ ID NO: 208126 - protein, 39 aa, Artificial Sequence
  Description of Artificial Sequence: Synthetic polypeptide
SEECISTTNPVATEGYGQCVCGNSGEDDNAENFNSDTQS

SEQ ID NO: 208127 - protein, 39 aa, Artificial Sequence
  Description of Artificial Sequence: Synthetic polypeptide
SEECISTTNPVATEGYGQCAVCSNWGEHNAENFNSDTQS

SEQ ID NO: 208128 - protein, 39 aa, Artificial Sequence
  Description of Artificial Sequence: Synthetic polypeptide
SEECISTTNPVATCQYGQCVCSNWGEDHNTENFNSDTQA

SEQ ID NO: 208129 - protein, 38 aa, Artificial Sequence
  Description of Artificial Sequence: Synthetic polypeptide
DEMEISCTNPVAYEGYGQCVCGNSGEHNAENFNSDTQS

SEQ ID NO: 208130 - protein, 39 aa, Artificial Sequence
  Description of Artificial Sequence: Synthetic polypeptide
SEECIRTTNPVATEGYGQCVCSNWGEDHNDEFFISDTQS

SEQ ID NO: 208131 - protein, 39 aa, Artificial Sequence
  Description of Artificial Sequence: Synthetic polypeptide
DEACIRTTNPVAYEQYGQCVCGNWGEDHNAENFNSETQA

SEQ ID NO: 208132 - protein, 38 aa, Artificial Sequence
  Description of Artificial Sequence: Synthetic polypeptide
DEMEISCTNPVATEQYGQCVCQWGADHNIENFMSDTQS

SEQ ID NO: 208133 - protein, 39 aa, Artificial Sequence
  Description of Artificial Sequence: Synthetic polypeptide
DEMEISCTNPVATEGYGQCVCSNWEEDHNAENFNSDNQG

SEQ ID NO: 208134 - protein, 37 aa, Artificial Sequence
  Description of Artificial Sequence: Synthetic polypeptide
SEECIATTNPVAYEQYGQCSCPWMEDNAEHFISETQS

SEQ ID NO: 208135 - protein, 39 aa, Artificial Sequence
  Description of Artificial Sequence: Synthetic polypeptide
SEECISTTNPVATEGYGQCVCSNWEEDHNAENFNSDTQS

SEQ ID NO: 208136 - protein, 37 aa, Artificial Sequence
  Description of Artificial Sequence: Synthetic polypeptide
DEMEIRTTNPVSYEGYGCICSNWEEHNAENFISDTQS

SEQ ID NO: 208137 - protein, 39 aa, Artificial Sequence
  Description of Artificial Sequence: Synthetic polypeptide
DEEEISTTNPVAYEEYGQCVCQMWGEDHNAENFNSDPQS

SEQ ID NO: 208138 - protein, 39 aa, Artificial Sequence
  Description of Artificial Sequence: Synthetic polypeptide
DDAEIRTTNPVAYEGYGQCVCSNWGEDHNAENFNSETQA

SEQ ID NO: 208139 - protein, 39 aa, Artificial Sequence
  Description of Artificial Sequence: Synthetic polypeptide
DEEEISTTNPVAYEGYGQCVCGNWGEDHNAENFNSDTQP

SEQ ID NO: 208140 - protein, 39 aa, Artificial Sequence
  Description of Artificial Sequence: Synthetic polypeptide
DEEEISTTNPVAYEGYGQCVCGNWGEDHNAENFISDTQA

SEQ ID NO: 208141 - protein, 39 aa, Artificial Sequence
  Description of Artificial Sequence: Synthetic polypeptide
DEEEISTTNPVAYEGYGQCVCGNWGEDDNAENFNSETQP

SEQ ID NO: 208142 - protein, 39 aa, Artificial Sequence
  Description of Artificial Sequence: Synthetic polypeptide
DEEEISTTNPVAYEGYGQCTCSMWEEDDNAEYINSDTQS

SEQ ID NO: 208143 - protein, 40 aa, Artificial Sequence
  Description of Artificial Sequence: Synthetic polypeptide
DEEEISTTNPVAYEGYGQCQVCSNWGEDHNTENFNSETQA

SEQ ID NO: 208144 - protein, 40 aa, Artificial Sequence
  Description of Artificial Sequence: Synthetic polypeptide
DEEEISTTNPVAYEGYGQCQVCSNWGEDHNAENFNSETQA

SEQ ID NO: 208145 - protein, 40 aa, Artificial Sequence
  Description of Artificial Sequence: Synthetic polypeptide
DEEEISTTNPVAYEGYGQCQVCSNWGEDHNAENFNSDTQA

SEQ ID NO: 208146 - protein, 38 aa, Artificial Sequence
  Description of Artificial Sequence: Synthetic polypeptide
SEECISTTNPVAYEGYGCVCSNWGEDHNAEYFGSDTQA

SEQ ID NO: 208147 - protein, 40 aa, Artificial Sequence
  Description of Artificial Sequence: Synthetic polypeptide
DEEEISTTNPVAYEGYGQCIVCSNWGEDHNAENFNSDTQF

SEQ ID NO: 208148 - protein, 39 aa, Artificial Sequence
  Description of Artificial Sequence: Synthetic polypeptide
DDAEIRTTNPVAYEGYGQCVCSNWGEDHNAENFNSDTQS

SEQ ID NO: 208149 - protein, 40 aa, Artificial Sequence
  Description of Artificial Sequence: Synthetic polypeptide
DDAEISCTNPVATEQYGQCQVCSTWGEDHNAENFNSDTQS

SEQ ID NO: 208150 - protein, 39 aa, Artificial Sequence
  Description of Artificial Sequence: Synthetic polypeptide
DEEEISTTNPVAYEGYGQCICSNWGEDDNAENFNSDNQS

SEQ ID NO: 208151 - protein, 40 aa, Artificial Sequence
  Description of Artificial Sequence: Synthetic polypeptide
DEEEISTTNPVAYEGYGQCAVCSNWGEDHNTEGFISDNQA

SEQ ID NO: 208152 - protein, 40 aa, Artificial Sequence
  Description of Artificial Sequence: Synthetic polypeptide
DEEEISTTNPVAYEGYGQCAVCSNWGEDHNQENFNSDTQS

SEQ ID NO: 208153 - protein, 40 aa, Artificial Sequence
  Description of Artificial Sequence: Synthetic polypeptide
DEEEISTTNPVAYEGYGQCAVCSNWGEDHNAENFNSDTQS

SEQ ID NO: 208154 - protein, 38 aa, Artificial Sequence
  Description of Artificial Sequence: Synthetic polypeptide
DEYEIATTNPIATECWGATYYANENDHQLHEKTRKGMS

SEQ ID NO: 208155 - protein, 36 aa, Artificial Sequence
  Description of Artificial Sequence: Synthetic polypeptide
DEYAIRTTNPIATECWWGATTWANAEDWAESKNPYI

SEQ ID NO: 208156 - protein, 39 aa, Artificial Sequence
  Description of Artificial Sequence: Synthetic polypeptide
DDAEIRTTNPVAYEQWGQCVCSNWGEDHNAENFNSDNQS

SEQ ID NO: 208157 - protein, 39 aa, Artificial Sequence
  Description of Artificial Sequence: Synthetic polypeptide
DEEEISTTNPVAYEGWGQCVCSNWGEDHNAENFNSDNAS

SEQ ID NO: 208158 - protein, 39 aa, Artificial Sequence
  Description of Artificial Sequence: Synthetic polypeptide
DDAEIRTTNPVAYEGYGQCVCSNWGEDHNIENFNSDTQS

SEQ ID NO: 208159 - protein, 38 aa, Artificial Sequence
  Description of Artificial Sequence: Synthetic polypeptide
DDAEISCTNPVATEGYGCVCSNWGEDHNAENFNSENQL

SEQ ID NO: 208160 - protein, 38 aa, Artificial Sequence
  Description of Artificial Sequence: Synthetic polypeptide
AENEIATTNPVATEGYGQCVCSWGEGDNAEHFISETQA

SEQ ID NO: 208161 - protein, 39 aa, Artificial Sequence
  Description of Artificial Sequence: Synthetic polypeptide
AENEIACTNPVATEQYGICSCSNWGEDDNTEYFGSDTQA

SEQ ID NO: 208162 - protein, 38 aa, Artificial Sequence
  Description of Artificial Sequence: Synthetic polypeptide
SEECIATTNPVATEQYGCSCPNWEEDDNQEHFISETQS

SEQ ID NO: 208163 - protein, 39 aa, Artificial Sequence
  Description of Artificial Sequence: Synthetic polypeptide
SEDEIRTTNPVAYEQWGVACYTGDELHNDQNTQGQDDDT

SEQ ID NO: 208164 - protein, 38 aa, Artificial Sequence
  Description of Artificial Sequence: Synthetic polypeptide
DEECISCTNPVATEGYGQCVCQNWGEHNAENFNSETQA

SEQ ID NO: 208165 - protein, 39 aa, Artificial Sequence
  Description of Artificial Sequence: Synthetic polypeptide
DEECISCTNPVATEGYGQCVCSNWEEDHNAEGFNSDTQS

SEQ ID NO: 208166 - protein, 39 aa, Artificial Sequence
  Description of Artificial Sequence: Synthetic polypeptide
DEAEIATTNPVATCQYGQCVCSNWGADDNQENFSSDTQS

SEQ ID NO: 208167 - protein, 38 aa, Artificial Sequence
  Description of Artificial Sequence: Synthetic polypeptide
DDACISTTNPVAYEQYGCVCSNWGEDHNAENFISDNQS

SEQ ID NO: 208168 - protein, 37 aa, Artificial Sequence
  Description of Artificial Sequence: Synthetic polypeptide
DEVEIATTNPVAYEPWGRPPPAGQGPALIHQDGMEAV

SEQ ID NO: 208169 - protein, 39 aa, Artificial Sequence
  Description of Artificial Sequence: Synthetic polypeptide
DEECISCTNPVATEGYGQCVCSNWEEDHNIENFNSDPQA

SEQ ID NO: 208170 - protein, 38 aa, Artificial Sequence
  Description of Artificial Sequence: Synthetic polypeptide
AEEEISTTNPVAYEGWGQCVCSNWGEHNAENFNSEPQA

SEQ ID NO: 208171 - protein, 40 aa, Artificial Sequence
  Description of Artificial Sequence: Synthetic polypeptide
CEEEISTTNPVATEQYGQCQVCPNWGEDHNAENFNSDNQA

SEQ ID NO: 208172 - protein, 39 aa, Artificial Sequence
  Description of Artificial Sequence: Synthetic polypeptide
DDACISTTNPVAYEQYGQCVCSNWGEDHNAENFGSDNQA

SEQ ID NO: 208173 - protein, 40 aa, Artificial Sequence
  Description of Artificial Sequence: Synthetic polypeptide
CEEEISTTNPVATEQYGQCQVCSNWGEDHNAENFISDFQA

SEQ ID NO: 208174 - protein, 39 aa, Artificial Sequence
  Description of Artificial Sequence: Synthetic polypeptide
AEEEISTTNPVAYEEYGQCVCSNWGEDHNAENFLSDNQP

SEQ ID NO: 208175 - protein, 38 aa, Artificial Sequence
  Description of Artificial Sequence: Synthetic polypeptide
QEEEIACTNPVATEQWGHVVAAGGAGGENTPDVQDSMM

SEQ ID NO: 208176 - protein, 37 aa, Artificial Sequence
  Description of Artificial Sequence: Synthetic polypeptide
SEDEIATTNPVAYEPWGRPPSAGQGPALTHQDGMEAV

SEQ ID NO: 208177 - protein, 37 aa, Artificial Sequence
  Description of Artificial Sequence: Synthetic polypeptide
SEDEIATTNPVAYEPQWGGCTVAANNGGTTANPDDNN

SEQ ID NO: 208178 - protein, 39 aa, Artificial Sequence
  Description of Artificial Sequence: Synthetic polypeptide
AENEIATTNPVATEGYGCQVCSNWGEDDNQEHFISENQA

SEQ ID NO: 208179 - protein, 38 aa, Artificial Sequence
  Description of Artificial Sequence: Synthetic polypeptide
AENEIATTNPVATEGYGCQVCSNWGEDNTEHFISETQA

SEQ ID NO: 208180 - protein, 39 aa, Artificial Sequence
  Description of Artificial Sequence: Synthetic polypeptide
AENEIATTNPVATEGYGICVCSNWGEDDNIEHFISENQA

SEQ ID NO: 208181 - protein, 40 aa, Artificial Sequence
  Description of Artificial Sequence: Synthetic polypeptide
DEECISCTNPVATEQYGQCAVCSNWGEDHNTENFNSETQF

SEQ ID NO: 208182 - protein, 40 aa, Artificial Sequence
  Description of Artificial Sequence: Synthetic polypeptide
DEEEIRTTNPVAYEQWGICQVCSYWGEDHNAENFSSDTFS

SEQ ID NO: 208183 - protein, 38 aa, Artificial Sequence
  Description of Artificial Sequence: Synthetic polypeptide
AEEEISTTNPVAYEGWGCVCSNWGEDHNAENFNSDNQS

SEQ ID NO: 208184 - protein, 39 aa, Artificial Sequence
  Description of Artificial Sequence: Synthetic polypeptide
DEDEIRTTNPVAYEEWGVACYTGDELHMDQNTQGQDDDE

SEQ ID NO: 208185 - protein, 37 aa, Artificial Sequence
  Description of Artificial Sequence: Synthetic polypeptide
EENEICATNPVAYEAWGCVYSGGQVGNTAGELREGSM

SEQ ID NO: 208186 - protein, 35 aa, Artificial Sequence
  Description of Artificial Sequence: Synthetic polypeptide
EENEIATTNPVAYEPWGPNVAGEGPQQNHMEMQLN

SEQ ID NO: 208187 - protein, 39 aa, Artificial Sequence
  Description of Artificial Sequence: Synthetic polypeptide
AENEIACTNPVATEQYGQCSCSNWGELDNQEYFISDTQS

SEQ ID NO: 208188 - protein, 39 aa, Artificial Sequence
  Description of Artificial Sequence: Synthetic polypeptide
DEMEIRTTNPVAYEQFGTCVCSNWGYDDNAEHFISDTQS

SEQ ID NO: 208189 - protein, 39 aa, Artificial Sequence
  Description of Artificial Sequence: Synthetic polypeptide
DDAEIRTTNPVATEQYGQCCCSNWGEDHNQEHFISDTQA

SEQ ID NO: 208190 - protein, 39 aa, Artificial Sequence
  Description of Artificial Sequence: Synthetic polypeptide
DEECISCTNPCATEQYGQCVCGNWEEDHNAEGFNSDTQS

SEQ ID NO: 208191 - protein, 38 aa, Artificial Sequence
  Description of Artificial Sequence: Synthetic polypeptide
DEEEIRTTNPCAYYEPPWGNSPIAASDHVGEGGDIEAM

SEQ ID NO: 208192 - protein, 39 aa, Artificial Sequence
  Description of Artificial Sequence: Synthetic polypeptide
DEEEIRTTNPCAYYTEPPPWGSPIAASDHVGEGGDIEAM

SEQ ID NO: 208193 - protein, 38 aa, Artificial Sequence
  Description of Artificial Sequence: Synthetic polypeptide
CETNEIATTNPVAYERWGSVACGQPNEEQGEQMGMDHS

SEQ ID NO: 208194 - protein, 37 aa, Artificial Sequence
  Description of Artificial Sequence: Synthetic polypeptide
AENEIACTNPVAYEQYGCSCSNWGEDNAEYFSSDTQS

SEQ ID NO: 208195 - protein, 37 aa, Artificial Sequence
  Description of Artificial Sequence: Synthetic polypeptide
CQEEIACTNPVAYEQWGHCFVATGEHADIGNSDEPAM

SEQ ID NO: 208196 - protein, 39 aa, Artificial Sequence
  Description of Artificial Sequence: Synthetic polypeptide
SEEAEIATTNPVAYERWGVCVQWETRNNDTNREGGGKKM

SEQ ID NO: 208197 - protein, 39 aa, Artificial Sequence
  Description of Artificial Sequence: Synthetic polypeptide
DENEIRTTNPVAYEGWGQCVTSNWGEDHNTENFISDTAS

SEQ ID NO: 208198 - protein, 37 aa, Artificial Sequence
  Description of Artificial Sequence: Synthetic polypeptide
DEAEIATTNPVAYEQWGPNCIAGEHGGENPAGENGMD

SEQ ID NO: 208199 - protein, 39 aa, Artificial Sequence
  Description of Artificial Sequence: Synthetic polypeptide
DDAEIGTTNPVAYEQYGQCVCSNWGEDHNAENFNSDTQA

SEQ ID NO: 208200 - protein, 39 aa, Artificial Sequence
  Description of Artificial Sequence: Synthetic polypeptide
DDECISTTNPVATEQYGQCVCSNWGEDHNAENFMSDTQS

SEQ ID NO: 208201 - protein, 38 aa, Artificial Sequence
  Description of Artificial Sequence: Synthetic polypeptide
DDAEIGTTNPVAYEGYGQCVCSNWEEHNAENFNSDTQS

SEQ ID NO: 208202 - protein, 39 aa, Artificial Sequence
  Description of Artificial Sequence: Synthetic polypeptide
CTEASEIVCTTNPVAYEQWGSVCAMNNGATQGAPGGQAA

SEQ ID NO: 208203 - protein, 39 aa, Artificial Sequence
  Description of Artificial Sequence: Synthetic polypeptide
SEEAISTTNPVAYEQYGQCVCSNWGEDHNAEHFISENQS

SEQ ID NO: 208204 - protein, 39 aa, Artificial Sequence
  Description of Artificial Sequence: Synthetic polypeptide
SEEAISTTNPVAYEGYGQCVCSTWGEDHNAEYFNSENQA

SEQ ID NO: 208205 - protein, 39 aa, Artificial Sequence
  Description of Artificial Sequence: Synthetic polypeptide
DDACISTTNPVAYEQYGQCVCSTWGEDDNAENFNSDTQA

SEQ ID NO: 208206 - protein, 38 aa, Artificial Sequence
  Description of Artificial Sequence: Synthetic polypeptide
CTEDEIACTNPVATESYGCVPAGATGHNPEAEAPPGDE

SEQ ID NO: 208207 - protein, 37 aa, Artificial Sequence
  Description of Artificial Sequence: Synthetic polypeptide
EENEIATTNPVAYEAWGVVWPGPNNENDGGTQMNGEM

SEQ ID NO: 208208 - protein, 37 aa, Artificial Sequence
  Description of Artificial Sequence: Synthetic polypeptide
SEMEIACTNPCSYEQYGCVCSNWGEDDNASFGSDNQS

SEQ ID NO: 208209 - protein, 39 aa, Artificial Sequence
  Description of Artificial Sequence: Synthetic polypeptide
DEEVIACTNPVAYEQWGCSVIATTGPHGDNSAEGIGQLE

SEQ ID NO: 208210 - protein, 40 aa, Artificial Sequence
  Description of Artificial Sequence: Synthetic polypeptide
DEECISTTNPVATEEYGQCAVCSNWGEDHNTEGFISDNQS

SEQ ID NO: 208211 - protein, 39 aa, Artificial Sequence
  Description of Artificial Sequence: Synthetic polypeptide
SDAEISTTNPVATEQYGQCVCSNWGEDHNAENSNSDTQS

SEQ ID NO: 208212 - protein, 38 aa, Artificial Sequence
  Description of Artificial Sequence: Synthetic polypeptide
DEACIRTTNPLATEQWGCVCSNWGEDDNQESFISDTQS

SEQ ID NO: 208213 - protein, 39 aa, Artificial Sequence
  Description of Artificial Sequence: Synthetic polypeptide
DEACIRTTNPLATEQFGQCVCSNWGEDHNAESFGSDTQA

SEQ ID NO: 208214 - protein, 35 aa, Artificial Sequence
  Description of Artificial Sequence: Synthetic polypeptide
SETEIRATNPIATECWGATTWANAEDWAEPKGPYI

SEQ ID NO: 208215 - protein, 35 aa, Artificial Sequence
  Description of Artificial Sequence: Synthetic polypeptide
SETEIRCTNPIATECWGATTWANAEDWAEPKGPYI

SEQ ID NO: 208216 - protein, 36 aa, Artificial Sequence
  Description of Artificial Sequence: Synthetic polypeptide
SETEIRTTNPIATECWGATTWANAEDWAAEPKGPYI

SEQ ID NO: 208217 - protein, 36 aa, Artificial Sequence
  Description of Artificial Sequence: Synthetic polypeptide
SETEIRTTNPIATECWGATTWANAEDWAEPKGGPYI

SEQ ID NO: 208218 - protein, 37 aa, Artificial Sequence
  Description of Artificial Sequence: Synthetic polypeptide
DETEIRTTNPIAYERWGATTVACAEDEWSTEPKVLYP

SEQ ID NO: 208219 - protein, 36 aa, Artificial Sequence
  Description of Artificial Sequence: Synthetic polypeptide
DETEIRTTNPIAYECWGATTWANAEDWAEPKGPYIV

SEQ ID NO: 208220 - protein, 39 aa, Artificial Sequence
  Description of Artificial Sequence: Synthetic polypeptide
DEACIRTTNPVATEGYGICVCSNWVEDDNAENFISDTQS

SEQ ID NO: 208221 - protein, 39 aa, Artificial Sequence
  Description of Artificial Sequence: Synthetic polypeptide
SEVEIATTNPVAYEQWGHIAVGRPTEGGRQGEQGQQEIR

SEQ ID NO: 208222 - protein, 38 aa, Artificial Sequence
  Description of Artificial Sequence: Synthetic polypeptide
SDAEIRCTNPVATEQYGCVCENWGEDHNAEHFNSDTQA

SEQ ID NO: 208223 - protein, 39 aa, Artificial Sequence
  Description of Artificial Sequence: Synthetic polypeptide
DDECISTTNPVAYEQYGQCVCSNWGEDDNAEHFNSDFQS

SEQ ID NO: 208224 - protein, 39 aa, Artificial Sequence
  Description of Artificial Sequence: Synthetic polypeptide
SEYEIRCTNPVATEQYGQCVCQNWGEDHNAEHFNSDTQS

SEQ ID NO: 208225 - protein, 37 aa, Artificial Sequence
  Description of Artificial Sequence: Synthetic polypeptide
DAAEIATTNPVAYEQWGTTSAGDGPAGNPAGIPNEDN

SEQ ID NO: 208226 - protein, 38 aa, Artificial Sequence
  Description of Artificial Sequence: Synthetic polypeptide
SEYEISCTNPVATEQYGCVCQNWGEDHNAEHFGSDTQS

SEQ ID NO: 208227 - protein, 39 aa, Artificial Sequence
  Description of Artificial Sequence: Synthetic polypeptide
SEYEISCTNPVATEQYGQCVCETWGEDDNAEHFNSDTQA

SEQ ID NO: 208228 - protein, 39 aa, Artificial Sequence
  Description of Artificial Sequence: Synthetic polypeptide
DDECISTTNPVAYEQYGQCVCSNWGEDHNAEFFNSETQS

SEQ ID NO: 208229 - protein, 39 aa, Artificial Sequence
  Description of Artificial Sequence: Synthetic polypeptide
DDECISTTNPVAYEQYGQCVCSNWGEDHNAENFGSDTQS

SEQ ID NO: 208230 - protein, 36 aa, Artificial Sequence
  Description of Artificial Sequence: Synthetic polypeptide
SAQEIATTNPVAYEQWGSICAMNNGGEPDIGGGEMW

SEQ ID NO: 208231 - protein, 39 aa, Artificial Sequence
  Description of Artificial Sequence: Synthetic polypeptide
SDAEIRTTNPVATEGYGQCVCSNWGEDHNAENFNSETQS

SEQ ID NO: 208232 - protein, 36 aa, Artificial Sequence
  Description of Artificial Sequence: Synthetic polypeptide
DETEIRTTNPIATEPWGATTPACIEDWSEEPTGPYN

SEQ ID NO: 208233 - protein, 37 aa, Artificial Sequence
  Description of Artificial Sequence: Synthetic polypeptide
DAAEIATTNPVAYEPPWGTNFSAGTGPAGNAHGDNGA

SEQ ID NO: 208234 - protein, 37 aa, Artificial Sequence
  Description of Artificial Sequence: Synthetic polypeptide
DAAEIATTNPVAYAQWGGCNTAGNNGPTTAEGGNLES

SEQ ID NO: 208235 - protein, 40 aa, Artificial Sequence
  Description of Artificial Sequence: Synthetic polypeptide
SENEISTTNPVATEGYGQCAVCSTWEEDHNAENFNSEFQS

SEQ ID NO: 208236 - protein, 40 aa, Artificial Sequence
  Description of Artificial Sequence: Synthetic polypeptide
DENEIRTTNPVATEGYGQCAVCSNWEEDHNIENFISEFQS

SEQ ID NO: 208237 - protein, 40 aa, Artificial Sequence
  Description of Artificial Sequence: Synthetic polypeptide
DENEIRTTNPVATEGYGQCAVCGNWEEDHNAENFNSEFQS

SEQ ID NO: 208238 - protein, 38 aa, Artificial Sequence
  Description of Artificial Sequence: Synthetic polypeptide
DDECISTTNPVAYEQYGCVCGNWGEDHNAENFNSDNQM

SEQ ID NO: 208239 - protein, 38 aa, Artificial Sequence
  Description of Artificial Sequence: Synthetic polypeptide
DDECISTTNPVAYEQYGCVCPNWGEDHNAEFFNSDTQS

SEQ ID NO: 208240 - protein, 39 aa, Artificial Sequence
  Description of Artificial Sequence: Synthetic polypeptide
SENEISTTNPVATEYYGQCVCSNWGEDHNAENFNSQTQS

SEQ ID NO: 208241 - protein, 39 aa, Artificial Sequence
  Description of Artificial Sequence: Synthetic polypeptide
SDECISTTNPVATEQYGQCVCSNWGEDHNAEFFNSDTQA

SEQ ID NO: 208242 - protein, 39 aa, Artificial Sequence
  Description of Artificial Sequence: Synthetic polypeptide
SENEISTTNPVAYEGYGQCVCSNWGEDTNAEHFNSDTQS

SEQ ID NO: 208243 - protein, 39 aa, Artificial Sequence
  Description of Artificial Sequence: Synthetic polypeptide
AEREISTTNPVAYEQYGQCVCSNWMEDHNAENFNSDTQA

SEQ ID NO: 208244 - protein, 36 aa, Artificial Sequence
  Description of Artificial Sequence: Synthetic polypeptide
DAAEIATTNPVAYASWGCNTAGNNGLTTAEHGNLDS

SEQ ID NO: 208245 - protein, 38 aa, Artificial Sequence
  Description of Artificial Sequence: Synthetic polypeptide
SENTIRTTNPVCATECDYLSCSATTTEEHVPNTPPPFT

SEQ ID NO: 208246 - protein, 38 aa, Artificial Sequence
  Description of Artificial Sequence: Synthetic polypeptide
SEQEIATTNPVAYEQWGHCIIFAGNSGLVDNDGENDAD

SEQ ID NO: 208247 - protein, 36 aa, Artificial Sequence
  Description of Artificial Sequence: Synthetic polypeptide
QEDEIATTNPVAYEPVWGPNVAGEGLQQNHMEMQLN

SEQ ID NO: 208248 - protein, 39 aa, Artificial Sequence
  Description of Artificial Sequence: Synthetic polypeptide
DDECISTTNPVAYEQYGQCVCSMWGEDHNAENFNSDTQF

SEQ ID NO: 208249 - protein, 39 aa, Artificial Sequence
  Description of Artificial Sequence: Synthetic polypeptide
DDECISTTNPVAYEQYGQCVCSNSGEDHNAENFNSDTQA

SEQ ID NO: 208250 - protein, 38 aa, Artificial Sequence
  Description of Artificial Sequence: Synthetic polypeptide
SDAEISTTNPVAYEQYGQCVCSNWGEHNAENFISDNQP

SEQ ID NO: 208251 - protein, 40 aa, Artificial Sequence
  Description of Artificial Sequence: Synthetic polypeptide
SEREISTTNPVATEQYGQCQVCSNWGEDHNAENFNSDTQS

SEQ ID NO: 208252 - protein, 39 aa, Artificial Sequence
  Description of Artificial Sequence: Synthetic polypeptide
SESCAEIATTNPVAYEQWGCVQWETNNNDTNKPGGGRNM

SEQ ID NO: 208253 - protein, 37 aa, Artificial Sequence
  Description of Artificial Sequence: Synthetic polypeptide
SESEIACTNPVGTEGYGQCSCQSGEDNQEYFGSDTQS

SEQ ID NO: 208254 - protein, 37 aa, Artificial Sequence
  Description of Artificial Sequence: Synthetic polypeptide
SESEIASTNPVGTEGYGQCSCGSGEHNQEHFGSDTQS

SEQ ID NO: 208255 - protein, 37 aa, Artificial Sequence
  Description of Artificial Sequence: Synthetic polypeptide
SEPEIACTNPVAYEQWGHCFVATGEHADIGNSDESAM

SEQ ID NO: 208256 - protein, 39 aa, Artificial Sequence
  Description of Artificial Sequence: Synthetic polypeptide
SDEEISTTNPVATEGYGQCIVCSNWGEHNTENFNSETQS

SEQ ID NO: 208257 - protein, 36 aa, Artificial Sequence
  Description of Artificial Sequence: Synthetic polypeptide
DETEIRTTNPIATEPWGATTPACAEDHAEPTGTPYI

SEQ ID NO: 208258 - protein, 37 aa, Artificial Sequence
  Description of Artificial Sequence: Synthetic polypeptide
DAAEIATTNPVAYEQWGTTSSGDGPAGNAHGMGAGMK

SEQ ID NO: 208259 - protein, 38 aa, Artificial Sequence
  Description of Artificial Sequence: Synthetic polypeptide
SAEEIATTNPVATEQWGCVAAGPNPAPEAGTPMEDGHG

SEQ ID NO: 208260 - protein, 39 aa, Artificial Sequence
  Description of Artificial Sequence: Synthetic polypeptide
DEECISTTNPVATEGYGQCVCSNWGEDHNAENFMSQTQS

SEQ ID NO: 208261 - protein, 39 aa, Artificial Sequence
  Description of Artificial Sequence: Synthetic polypeptide
DEECISTTNPVATEGYGQCVCSNWGEDHNIENFISETQA

SEQ ID NO: 208262 - protein, 39 aa, Artificial Sequence
  Description of Artificial Sequence: Synthetic polypeptide
DEECISTTNPVATEGYGQCVCSNWGEDHNQENFISEFQS

SEQ ID NO: 208263 - protein, 38 aa, Artificial Sequence
  Description of Artificial Sequence: Synthetic polypeptide
SAEEIAPTNPVAYEQYGSVAACPGPAPEAGTPMEDPRW

SEQ ID NO: 208264 - protein, 38 aa, Artificial Sequence
  Description of Artificial Sequence: Synthetic polypeptide
DEAEIRTTNPIATEGWGCQTCQNSEEDNAENSISDNQA

SEQ ID NO: 208265 - protein, 39 aa, Artificial Sequence
  Description of Artificial Sequence: Synthetic polypeptide
DEAAISTTNPVAYEQYGQCVCSNSGEDHNAENFGSDTQA

SEQ ID NO: 208266 - protein, 38 aa, Artificial Sequence
  Description of Artificial Sequence: Synthetic polypeptide
DEAAISTTNPVAYEQYGQCFCSNWGEHNIENFGSDTQS

SEQ ID NO: 208267 - protein, 40 aa, Artificial Sequence
  Description of Artificial Sequence: Synthetic polypeptide
AEEEISTTNPVATEQYGQCQVCSNWGEDHNAENFFSETQS

SEQ ID NO: 208268 - protein, 39 aa, Artificial Sequence
  Description of Artificial Sequence: Synthetic polypeptide
DEECISTTNPVATEGYGQCVCENWGEDHNAEFFNSDTQS

SEQ ID NO: 208269 - protein, 40 aa, Artificial Sequence
  Description of Artificial Sequence: Synthetic polypeptide
AEEEISTTNPVATEQYGQCQVCQNWGEPHNAENFNSEFQS

SEQ ID NO: 208270 - protein, 37 aa, Artificial Sequence
  Description of Artificial Sequence: Synthetic polypeptide
QSDCIRTTNPVATEPWGWIQSCCDPMQSEEDGGMNQT

SEQ ID NO: 208271 - protein, 36 aa, Artificial Sequence
  Description of Artificial Sequence: Synthetic polypeptide
QSDCIGTTNPVATEPWGWIQSCCPMQSESEGGMNQT

SEQ ID NO: 208272 - protein, 37 aa, Artificial Sequence
  Description of Artificial Sequence: Synthetic polypeptide
QQSEIAPTNPCSYEQYGETVSCWGHMLSQNSNGGTDR

SEQ ID NO: 208273 - protein, 39 aa, Artificial Sequence
  Description of Artificial Sequence: Synthetic polypeptide
DEAEIRTTNPIATEGWGCQSCGNWEEDDNAENSGSDNQS

SEQ ID NO: 208274 - protein, 41 aa, Artificial Sequence
  Description of Artificial Sequence: Synthetic polypeptide
DEEVIRTTNPVAYDAFEQGNCIVSNTPWHLPEGQIEVSQRM

SEQ ID NO: 208275 - protein, 37 aa, Artificial Sequence
  Description of Artificial Sequence: Synthetic polypeptide
CEETITETTFPTSIEQYGYGVLITNVEVIQHVPQNVE

SEQ ID NO: 208276 - protein, 38 aa, Artificial Sequence
  Description of Artificial Sequence: Synthetic polypeptide
QEYEIATTNCVATEQYGVVAGPGEEGEGGQGGGEADTK

SEQ ID NO: 208277 - protein, 40 aa, Artificial Sequence
  Description of Artificial Sequence: Synthetic polypeptide
DEECISTTNPVATEQYGQCQVCSNWGEDHNAENFISEFQS

SEQ ID NO: 208278 - protein, 37 aa, Artificial Sequence
  Description of Artificial Sequence: Synthetic polypeptide
QEVTIGTTNPVATEAYGTVVSALDGGDEEEEGGGFDI

SEQ ID NO: 208279 - protein, 36 aa, Artificial Sequence
  Description of Artificial Sequence: Synthetic polypeptide
QSEEIATTNPVAYEWYGEHAPWCEHEFSHSHATGEP

SEQ ID NO: 208280 - protein, 36 aa, Artificial Sequence
  Description of Artificial Sequence: Synthetic polypeptide
DETEIRTTNPIATEPWGATAPACIEDWSAEPTGPYI

SEQ ID NO: 208281 - protein, 39 aa, Artificial Sequence
  Description of Artificial Sequence: Synthetic polypeptide
DEECISTTNPVATEGYGQCTCSMWEEDDNAEYINSDTQA

SEQ ID NO: 208282 - protein, 39 aa, Artificial Sequence
  Description of Artificial Sequence: Synthetic polypeptide
CEEEISTTNPVAYEQWGQCVCSNWGEDTNAENFISDTQS

SEQ ID NO: 208283 - protein, 37 aa, Artificial Sequence
  Description of Artificial Sequence: Synthetic polypeptide
DDECISTTNPVGTEQWGCVCSNWGEHNAENFISVTQS

SEQ ID NO: 208284 - protein, 39 aa, Artificial Sequence
  Description of Artificial Sequence: Synthetic polypeptide
SQEEIRTTNPVATEQWGQCVCSNWGEDHNAEYFISDTQA

SEQ ID NO: 208285 - protein, 36 aa, Artificial Sequence
  Description of Artificial Sequence: Synthetic polypeptide
DETEIRTTNPIATECWGTTTQACAEDWSAEPTGPYI

SEQ ID NO: 208286 - protein, 36 aa, Artificial Sequence
  Description of Artificial Sequence: Synthetic polypeptide
DETEIRTTNPIATECWGTTTPACAGDWAEPTGTPYI

SEQ ID NO: 208287 - protein, 38 aa, Artificial Sequence
  Description of Artificial Sequence: Synthetic polypeptide
SQEEIRTTNPVAYEGWGQCVCSNWGEHNAENFGSDTQA

SEQ ID NO: 208288 - protein, 38 aa, Artificial Sequence
  Description of Artificial Sequence: Synthetic polypeptide
SSAEIRTTNPVATHQYGCVCSNWGEDDNAENFISDTQS

SEQ ID NO: 208289 - protein, 37 aa, Artificial Sequence
  Description of Artificial Sequence: Synthetic polypeptide
DETEIRTTNPIATECWGKTTVACAEDWSAEPTGTPYH

SEQ ID NO: 208290 - protein, 36 aa, Artificial Sequence
  Description of Artificial Sequence: Synthetic polypeptide
SAEEIATTNPVAYAQWGCNTAGNNGPTTAEGGNLDQ

SEQ ID NO: 208291 - protein, 39 aa, Artificial Sequence
  Description of Artificial Sequence: Synthetic polypeptide
CEEEISTTNPVAYEAYGQCVCSNWGEDDNAENFNSDTQA

SEQ ID NO: 208292 - protein, 40 aa, Artificial Sequence
  Description of Artificial Sequence: Synthetic polypeptide
DEECISTTNPVATEGYGQCQVCSNWGEDHNTEGFISENQA

SEQ ID NO: 208293 - protein, 36 aa, Artificial Sequence
  Description of Artificial Sequence: Synthetic polypeptide
DETEIRTTNPIATECWGKTTPACAEDEWAETTGPYI

SEQ ID NO: 208294 - protein, 39 aa, Artificial Sequence
  Description of Artificial Sequence: Synthetic polypeptide
CEEEISTTNPVAYEGYGQCVCSNWGEDDNAENFNSDPQP

SEQ ID NO: 208295 - protein, 37 aa, Artificial Sequence
  Description of Artificial Sequence: Synthetic polypeptide
DETEIRTTNPIATECWGEATTWANAEDWKAEPKHPYI

SEQ ID NO: 208296 - protein, 39 aa, Artificial Sequence
  Description of Artificial Sequence: Synthetic polypeptide
DEACIGTTNPVAYEGYGQCVCSNWPEDHNTENFNSDNQA

SEQ ID NO: 208297 - protein, 39 aa, Artificial Sequence
  Description of Artificial Sequence: Synthetic polypeptide
SAEEIATTNPVATEQWGTNTVAATAHAGDNTAPGGDLHW

SEQ ID NO: 208298 - protein, 38 aa, Artificial Sequence
  Description of Artificial Sequence: Synthetic polypeptide
SSEEISTTNPVATHQYGCVCSNWGEDDNAEYFISDTQA

SEQ ID NO: 208299 - protein, 40 aa, Artificial Sequence
  Description of Artificial Sequence: Synthetic polypeptide
DEECISTTNPVATEGYGQCAVCSNWGEDHNAENFNSDTQL

SEQ ID NO: 208300 - protein, 40 aa, Artificial Sequence
  Description of Artificial Sequence: Synthetic polypeptide
DEACIGTTNPVATEQYGQCAVCSNWGEDHNAENFNSDTQA

SEQ ID NO: 208301 - protein, 39 aa, Artificial Sequence
  Description of Artificial Sequence: Synthetic polypeptide
DEACIGCTNPVAYEQYGQCVCSNWGEDHNTENFNSDNAS

SEQ ID NO: 208302 - protein, 36 aa, Artificial Sequence
  Description of Artificial Sequence: Synthetic polypeptide
DDSELACTNPVSTEGYGCVCGTWEHNAEYFGSQTQA

SEQ ID NO: 208303 - protein, 37 aa, Artificial Sequence
  Description of Artificial Sequence: Synthetic polypeptide
DETEIRTTNPIATECWGKTTCACAEDWSAEPNGGPYI

SEQ ID NO: 208304 - protein, 39 aa, Artificial Sequence
  Description of Artificial Sequence: Synthetic polypeptide
SDEEISTTNPVATEGYGQCVCGMSGEDHNAENFQSQTQS

SEQ ID NO: 208305 - protein, 39 aa, Artificial Sequence
  Description of Artificial Sequence: Synthetic polypeptide
SDEEISTTNPVATEGYGQCVCQNWGEGHNAENFNSDTQN

SEQ ID NO: 208306 - protein, 39 aa, Artificial Sequence
  Description of Artificial Sequence: Synthetic polypeptide
SDEEISTTNPVATEGYGQCVCSMSMEDHNAENFNSDTQS

SEQ ID NO: 208307 - protein, 37 aa, Artificial Sequence
  Description of Artificial Sequence: Synthetic polypeptide
SEMEIACTNPCSYEQYGQCVCSTWGEDNQSFGSDTQA

SEQ ID NO: 208308 - protein, 36 aa, Artificial Sequence
  Description of Artificial Sequence: Synthetic polypeptide
SEMEIACTNPCSYEQYGQCVCSWEDNQESFISDNQS

SEQ ID NO: 208309 - protein, 36 aa, Artificial Sequence
  Description of Artificial Sequence: Synthetic polypeptide
SEMEIACTNPCSYEQYGQCVCSWGEDNAESFNSDQS

SEQ ID NO: 208310 - protein, 36 aa, Artificial Sequence
  Description of Artificial Sequence: Synthetic polypeptide
SEMEIACTNPCSYEQYGQCVCSWGEHNQSFNSDNQA

SEQ ID NO: 208311 - protein, 37 aa, Artificial Sequence
  Description of Artificial Sequence: Synthetic polypeptide
SEMEIACTNPVGTEGYGQCSCGSGEDNAEHFNSDNQA

SEQ ID NO: 208312 - protein, 38 aa, Artificial Sequence
  Description of Artificial Sequence: Synthetic polypeptide
SEMEIATTNPVATEGYGQCVCSNWMEHNAEHFISETQA

SEQ ID NO: 208313 - protein, 39 aa, Artificial Sequence
  Description of Artificial Sequence: Synthetic polypeptide
SEACISTTNPVATEQYGQCVCSNWGEDHNAEGFNSDTQA

SEQ ID NO: 208314 - protein, 38 aa, Artificial Sequence
  Description of Artificial Sequence: Synthetic polypeptide
AENEIRTTNPVAYEQWGQCVCSNSGEENAEYSISDTAS

SEQ ID NO: 208315 - protein, 38 aa, Artificial Sequence
  Description of Artificial Sequence: Synthetic polypeptide
AENEIRTTNPVSYEGYGCICSNWEEDDNAEQFNSDNQS

SEQ ID NO: 208316 - protein, 36 aa, Artificial Sequence
  Description of Artificial Sequence: Synthetic polypeptide
SEMEIACTNPCSYEQYGQCVCSNWGEHNASFGSDQA

SEQ ID NO: 208317 - protein, 38 aa, Artificial Sequence
  Description of Artificial Sequence: Synthetic polypeptide
AENEISCTNPVATEGYGQCVCSNWGEHNAENFNSDNQS

SEQ ID NO: 208318 - protein, 38 aa, Artificial Sequence
  Description of Artificial Sequence: Synthetic polypeptide
SEMEISCTNPVATEQYGCVCENWGEDHNAEHFISDTQS

SEQ ID NO: 208319 - protein, 38 aa, Artificial Sequence
  Description of Artificial Sequence: Synthetic polypeptide
SEACISTTNPVATEGYGQCVCSNWEEHNTESFNSETQS

SEQ ID NO: 208320 - protein, 38 aa, Artificial Sequence
  Description of Artificial Sequence: Synthetic polypeptide
SEMEISTTNPVATCQYGQCVCSNWGEHNEEYFISDTQS

SEQ ID NO: 208321 - protein, 39 aa, Artificial Sequence
  Description of Artificial Sequence: Synthetic polypeptide
SEMEISTTNPVATEGYGQCVCGNSGEDHNAENFNSDTQS

SEQ ID NO: 208322 - protein, 39 aa, Artificial Sequence
  Description of Artificial Sequence: Synthetic polypeptide
SEMEISTTNPVATEQYGQCVCQNWGADHNIENFMSDTQS

SEQ ID NO: 208323 - protein, 39 aa, Artificial Sequence
  Description of Artificial Sequence: Synthetic polypeptide
SEMEISTTNPVAYEGYGQCVCSNWGEDTNAENFNSETQA

SEQ ID NO: 208324 - protein, 38 aa, Artificial Sequence
  Description of Artificial Sequence: Synthetic polypeptide
SEMEISTTNPVAYEGYGQCVCSNWGEPNAENFGSDTQA

SEQ ID NO: 208325 - protein, 39 aa, Artificial Sequence
  Description of Artificial Sequence: Synthetic polypeptide
SEMEISTTNPVAYEGYGQCVCSTWGEDHNAENFNSDNQG

SEQ ID NO: 208326 - protein, 39 aa, Artificial Sequence
  Description of Artificial Sequence: Synthetic polypeptide
SEMEISTTNPVAYEQYGQCVCSNSGEDHNAENFNSETQA

SEQ ID NO: 208327 - protein, 39 aa, Artificial Sequence
  Description of Artificial Sequence: Synthetic polypeptide
SEACISTTNPVATEQYGQCVCGTWGEDHNAEYFNSENQA

SEQ ID NO: 208328 - protein, 39 aa, Artificial Sequence
  Description of Artificial Sequence: Synthetic polypeptide
SEMEISTTNPVAYEQYGQCVCSNWGEDHNAENFNSDTQS

SEQ ID NO: 208329 - protein, 38 aa, Artificial Sequence
  Description of Artificial Sequence: Synthetic polypeptide
DDACIRTTNPVAYEQYGCCCSNWGEDHNAEHFNSDTQA

SEQ ID NO: 208330 - protein, 38 aa, Artificial Sequence
  Description of Artificial Sequence: Synthetic polypeptide
SEACISTTNPVAYEQYGQCVCSNWGEHNAENFNSDTQS

SEQ ID NO: 208331 - protein, 36 aa, Artificial Sequence
  Description of Artificial Sequence: Synthetic polypeptide
SEMEIACTNPCSYEQYGCVCSNWGEDNQSFISDNQA

SEQ ID NO: 208332 - protein, 36 aa, Artificial Sequence
  Description of Artificial Sequence: Synthetic polypeptide
SEMEIACTNPCSYEQYGCVCSNWGEGPNQSFGSDQA

SEQ ID NO: 208333 - protein, 36 aa, Artificial Sequence
  Description of Artificial Sequence: Synthetic polypeptide
SEMEIACTNPCSYEQYGCVCSNWGEHNQESFGSDQI

SEQ ID NO: 208334 - protein, 40 aa, Artificial Sequence
  Description of Artificial Sequence: Synthetic polypeptide
DEECISTTNPVATEEYGQCQVCSNWGYDHNTEGFNSENQA

SEQ ID NO: 208335 - protein, 37 aa, Artificial Sequence
  Description of Artificial Sequence: Synthetic polypeptide
SEMEIACTNPCSYEQYGCVCSNWGEPNAESFGSDNQA

SEQ ID NO: 208336 - protein, 36 aa, Artificial Sequence
  Description of Artificial Sequence: Synthetic polypeptide
SEMEIACTNPCSYEQYGCVCSNWMEHQESFGSDTQS

SEQ ID NO: 208337 - protein, 36 aa, Artificial Sequence
  Description of Artificial Sequence: Synthetic polypeptide
SEMEIACTNPCSYEQYGCVCSTWGEDNQESFISDQA

SEQ ID NO: 208338 - protein, 37 aa, Artificial Sequence
  Description of Artificial Sequence: Synthetic polypeptide
SEMEIACTNPCSYEQYGCVCSTWGEHNQESFNSDTQA

SEQ ID NO: 208339 - protein, 38 aa, Artificial Sequence
  Description of Artificial Sequence: Synthetic polypeptide
SEAEIACTNPVGTEGYGQCSCGNSGEDNAEHFGSDNQS

SEQ ID NO: 208340 - protein, 39 aa, Artificial Sequence
  Description of Artificial Sequence: Synthetic polypeptide
DDACIRTTNPVAYEQYGQCVCSNWGEDDNAENFNSENQS

SEQ ID NO: 208341 - protein, 36 aa, Artificial Sequence
  Description of Artificial Sequence: Synthetic polypeptide
SEMEIACTNPCSYEQYGCVCSWEADNQESFGSDTQS

SEQ ID NO: 208342 - protein, 36 aa, Artificial Sequence
  Description of Artificial Sequence: Synthetic polypeptide
SEMEIACTNPCSYEQYGCVCSWGEDHNQSFNSDTQA

SEQ ID NO: 208343 - protein, 36 aa, Artificial Sequence
  Description of Artificial Sequence: Synthetic polypeptide
SEMEIACTNPCSYEQYGCVCSWGEDNAESFISDNQS

SEQ ID NO: 208344 - protein, 36 aa, Artificial Sequence
  Description of Artificial Sequence: Synthetic polypeptide
SEMEIACTNPCSYEQYGCVCSWGEDNQENFGSDTQS

SEQ ID NO: 208345 - protein, 37 aa, Artificial Sequence
  Description of Artificial Sequence: Synthetic polypeptide
QEDEIATTNPVAYTYAQWGCVCAAGAGENPDNGEGAE

SEQ ID NO: 208346 - protein, 37 aa, Artificial Sequence
  Description of Artificial Sequence: Synthetic polypeptide
SEMEIACTNPCSYEQYGCVCSWGELDNQESFNSDTQS

SEQ ID NO: 208347 - protein, 36 aa, Artificial Sequence
  Description of Artificial Sequence: Synthetic polypeptide
SEMEIACTNPCSYEQYGCVCSWGELNAEHFGSDTQA

SEQ ID NO: 208348 - protein, 36 aa, Artificial Sequence
  Description of Artificial Sequence: Synthetic polypeptide
SEMEIACTNPCSYEQYGCVCSWGELNAESFNSDNQA

SEQ ID NO: 208349 - protein, 38 aa, Artificial Sequence
  Description of Artificial Sequence: Synthetic polypeptide
DDECISTTNPVAYEGYGQCVCSNWEEHNAEHFNSDTQA

SEQ ID NO: 208350 - protein, 38 aa, Artificial Sequence
  Description of Artificial Sequence: Synthetic polypeptide
SEACISTTNPVAYEQYGQCVCSNWGEHNTENFNSDTQS

SEQ ID NO: 208351 - protein, 36 aa, Artificial Sequence
  Description of Artificial Sequence: Synthetic polypeptide
SEMEIACTNPCSYEQYGCVCSWGEADNQESFGSDQS

SEQ ID NO: 208352 - protein, 38 aa, Artificial Sequence
  Description of Artificial Sequence: Synthetic polypeptide
SENAIATTNPVATEGYGCVCSNWGEDDNQEHFISENQA

SEQ ID NO: 208353 - protein, 38 aa, Artificial Sequence
  Description of Artificial Sequence: Synthetic polypeptide
SENCIATTNPVATEGYGQCVCSWGEDDNAEHFISENQA

SEQ ID NO: 208354 - protein, 37 aa, Artificial Sequence
  Description of Artificial Sequence: Synthetic polypeptide
SENCIATTNPVATEGYGQCVCSWMEHNAEHFISETQA

SEQ ID NO: 208355 - protein, 38 aa, Artificial Sequence
  Description of Artificial Sequence: Synthetic polypeptide
SDNEIATTNPVATEGYGCVCSNWGEAHNAEHFISENQA

SEQ ID NO: 208356 - protein, 37 aa, Artificial Sequence
  Description of Artificial Sequence: Synthetic polypeptide
SDNCIATTNPVATEGYGQCVCSWGEHNAEHFISENQA

SEQ ID NO: 208357 - protein, 38 aa, Artificial Sequence
  Description of Artificial Sequence: Synthetic polypeptide
DDAAISTTNPVATEEYGCVCSNWGEDHNEESFNSDTQS

SEQ ID NO: 208358 - protein, 35 aa, Artificial Sequence
  Description of Artificial Sequence: Synthetic polypeptide
SDMEIACTNPCSYEQYGCVCSWGEHNAESFGSDQA

SEQ ID NO: 208359 - protein, 36 aa, Artificial Sequence
  Description of Artificial Sequence: Synthetic polypeptide
SDMEIACTNPCSYEQYGCVCSWGEDNQESFGSDNQS

SEQ ID NO: 208360 - protein, 39 aa, Artificial Sequence
  Description of Artificial Sequence: Synthetic polypeptide
SDMCISTTNPVATEQYGQCVCSNWGEDTNAENFNSDTQS

SEQ ID NO: 208361 - protein, 39 aa, Artificial Sequence
  Description of Artificial Sequence: Synthetic polypeptide
SENEIRTTNPVATEQWGQCVCSNSGEDENAEYFISDTAS

SEQ ID NO: 208362 - protein, 38 aa, Artificial Sequence
  Description of Artificial Sequence: Synthetic polypeptide
AEQEIATTNPVAYEQWGHCIIFAGNNGLVDNDGENDAE

SEQ ID NO: 208363 - protein, 39 aa, Artificial Sequence
  Description of Artificial Sequence: Synthetic polypeptide
SDEEISTTNPVAYEQYGQCVCSNWGEEHNAENFNSDNQN

SEQ ID NO: 208364 - protein, 38 aa, Artificial Sequence
  Description of Artificial Sequence: Synthetic polypeptide
SDNEIATTNPVATEGYGQCVCSTWMEHNAEHFISETQA

SEQ ID NO: 208365 - protein, 37 aa, Artificial Sequence
  Description of Artificial Sequence: Synthetic polypeptide
DEAEIATTNPVAYAPWGSTVAGGEHGVATAGGPNGAM

SEQ ID NO: 208366 - protein, 39 aa, Artificial Sequence
  Description of Artificial Sequence: Synthetic polypeptide
SDEEISTTNPVAYEQYGQCVCSNWGEDDNAENFNSDTQP

SEQ ID NO: 208367 - protein, 39 aa, Artificial Sequence
  Description of Artificial Sequence: Synthetic polypeptide
SDEEISTTNPVAYEQYGQCVCSNWEEDHNAEHFNSETQA

SEQ ID NO: 208368 - protein, 37 aa, Artificial Sequence
  Description of Artificial Sequence: Synthetic polypeptide
DAAEIACTNPVAYEQWGTTSSGTGPAGGNPHGDNGMQ

SEQ ID NO: 208369 - protein, 39 aa, Artificial Sequence
  Description of Artificial Sequence: Synthetic polypeptide
SDEEISTTNPVAYEQYGQCVCGNSGEDHNAENFNSDTQS

SEQ ID NO: 208370 - protein, 38 aa, Artificial Sequence
  Description of Artificial Sequence: Synthetic polypeptide
AERCISTTNPVATEGYGQCVCSNWGEHNAENFNSETQS

SEQ ID NO: 208371 - protein, 39 aa, Artificial Sequence
  Description of Artificial Sequence: Synthetic polypeptide
AEREISTTNPVATEGYGQCVCSNWGEDDNAENFNSETQS

SEQ ID NO: 208372 - protein, 38 aa, Artificial Sequence
  Description of Artificial Sequence: Synthetic polypeptide
SENEIRTTNPVAYEQWGCVCSNSGEDHNAEYSISDTAS

SEQ ID NO: 208373 - protein, 39 aa, Artificial Sequence
  Description of Artificial Sequence: Synthetic polypeptide
SDEEISTTNPVAYEGYGQCVCSNWEEPHNTENFISDNQA

SEQ ID NO: 208374 - protein, 39 aa, Artificial Sequence
  Description of Artificial Sequence: Synthetic polypeptide
SDEEISTTNPVATEGYGQCVCSNWGEDHNAENFNSDTQS

SEQ ID NO: 208375 - protein, 38 aa, Artificial Sequence
  Description of Artificial Sequence: Synthetic polypeptide
DDAAIGTTNPVAYEGYGCVCSNWGEDHNTENFNSDNQS

SEQ ID NO: 208376 - protein, 39 aa, Artificial Sequence
  Description of Artificial Sequence: Synthetic polypeptide
DDAAISTTNPVATEQYGQCVCSNWGEDDNAENFNSDTQA

SEQ ID NO: 208377 - protein, 40 aa, Artificial Sequence
  Description of Artificial Sequence: Synthetic polypeptide
FAEYEIRTTNPVATDDQVWGSTWVPVSTSILIMFIVQVHV

SEQ ID NO: 208378 - protein, 38 aa, Artificial Sequence
  Description of Artificial Sequence: Synthetic polypeptide
DDAAISTTNPVAYEQYGQCVCSNWGEHNQENFGSDTQA

SEQ ID NO: 208379 - protein, 39 aa, Artificial Sequence
  Description of Artificial Sequence: Synthetic polypeptide
SEACIRTTNPVAYEQYGQCVCSNWGEDHNAENFNSETQS

SEQ ID NO: 208380 - protein, 37 aa, Artificial Sequence
  Description of Artificial Sequence: Synthetic polypeptide
SENEIACTNPVATEGYGCVCSNWEEHNAEHFISETQA

SEQ ID NO: 208381 - protein, 39 aa, Artificial Sequence
  Description of Artificial Sequence: Synthetic polypeptide
AENEISCTNPVAYEQYGQCVCSTWGEDHNAEYFNSDTQA

SEQ ID NO: 208382 - protein, 39 aa, Artificial Sequence
  Description of Artificial Sequence: Synthetic polypeptide
AENEISTTNPVATCQYGQCVCGNSGEDPNAENFNSQTQS

SEQ ID NO: 208383 - protein, 37 aa, Artificial Sequence
  Description of Artificial Sequence: Synthetic polypeptide
AENEISTTNPVATEGWGCVCSNSGEENAEYSISDTAS

SEQ ID NO: 208384 - protein, 39 aa, Artificial Sequence
  Description of Artificial Sequence: Synthetic polypeptide
AENEISTTNPVATEGYGQCAVCSTWEEHNAENFISEFQS

SEQ ID NO: 208385 - protein, 38 aa, Artificial Sequence
  Description of Artificial Sequence: Synthetic polypeptide
AENEISTTNPVATEQWGCVCSNSGEDDNAEYSISDTQS

SEQ ID NO: 208386 - protein, 39 aa, Artificial Sequence
  Description of Artificial Sequence: Synthetic polypeptide
AENEISTTNPVATEQWGQCVCSNWGEDHNAENFNSDTQS

SEQ ID NO: 208387 - protein, 39 aa, Artificial Sequence
  Description of Artificial Sequence: Synthetic polypeptide
AENEISTTNPVATEQYGQCVCSNWGEDHNAEFFISDTQS

SEQ ID NO: 208388 - protein, 39 aa, Artificial Sequence
  Description of Artificial Sequence: Synthetic polypeptide
SEAAISTTNPVAYEQYGQCVCSNWMEDHNTENFNSDNQS

SEQ ID NO: 208389 - protein, 39 aa, Artificial Sequence
  Description of Artificial Sequence: Synthetic polypeptide
AENEISTTNPVAYEGYGQCVCSNSGEDHNAENFGSDNQS

SEQ ID NO: 208390 - protein, 38 aa, Artificial Sequence
  Description of Artificial Sequence: Synthetic polypeptide
AENEISTTNPVAYEGYGQCVCSNWGEDNAENFNSDNQS

SEQ ID NO: 208391 - protein, 38 aa, Artificial Sequence
  Description of Artificial Sequence: Synthetic polypeptide
SENEIATTNPVAYEGYGCVCSNWGEDDNAEHFISENQA

SEQ ID NO: 208392 - protein, 38 aa, Artificial Sequence
  Description of Artificial Sequence: Synthetic polypeptide
SENEIATTNPVAYEGYGICVCSNWGEHNAEHFISENQA

SEQ ID NO: 208393 - protein, 39 aa, Artificial Sequence
  Description of Artificial Sequence: Synthetic polypeptide
AENEISTTNPVAYEQYGQCVCSNWGEDHNAEYFNSDNQS

SEQ ID NO: 208394 - protein, 36 aa, Artificial Sequence
  Description of Artificial Sequence: Synthetic polypeptide
QEHEIATTNPVAYESYGTHAPWCQHEFSIHAEGEWQ

SEQ ID NO: 208395 - protein, 37 aa, Artificial Sequence
  Description of Artificial Sequence: Synthetic polypeptide
DSSEVASTNPVSYEPYGNVVAANATISQYSTGGINRL

SEQ ID NO: 208396 - protein, 36 aa, Artificial Sequence
  Description of Artificial Sequence: Synthetic polypeptide
QEHEIATTNPVAYESYGEHAPNCEHEFSINAEGEWC

SEQ ID NO: 208397 - protein, 38 aa, Artificial Sequence
  Description of Artificial Sequence: Synthetic polypeptide
DDECISTTNPVAYEGYGQCVCSNWEEHNTEHFNSDTQG

SEQ ID NO: 208398 - protein, 35 aa, Artificial Sequence
  Description of Artificial Sequence: Synthetic polypeptide
QEHEIATTNPVAYAPWGPNVAGEGLQQNHMEMQLN

SEQ ID NO: 208399 - protein, 38 aa, Artificial Sequence
  Description of Artificial Sequence: Synthetic polypeptide
QEHEIATTNPVAYAPPWSVTSGTGEPLGIAHQGDNSDD

SEQ ID NO: 208400 - protein, 39 aa, Artificial Sequence
  Description of Artificial Sequence: Synthetic polypeptide
DEEEISTTNPVAYEGYGQCVCSNWEEDHNAENFISDTQS

SEQ ID NO: 208401 - protein, 39 aa, Artificial Sequence
  Description of Artificial Sequence: Synthetic polypeptide
DEEEISTTNPVAYEGYGQCVCSNWGEDDNAEYFISDTQA

SEQ ID NO: 208402 - protein, 38 aa, Artificial Sequence
  Description of Artificial Sequence: Synthetic polypeptide
DEMEISTTNPVATEGYGICVCQWVEDHNAENFISDTQA

SEQ ID NO: 208403 - protein, 39 aa, Artificial Sequence
  Description of Artificial Sequence: Synthetic polypeptide
DEEEISTTNPVAYEGYGQCVCSNWGEDHNAENFISDFQA

SEQ ID NO: 208404 - protein, 38 aa, Artificial Sequence
  Description of Artificial Sequence: Synthetic polypeptide
AEMEISTTNPVAYEGYGQCVCSNWGEHNAENFNSDNQS

SEQ ID NO: 208405 - protein, 39 aa, Artificial Sequence
  Description of Artificial Sequence: Synthetic polypeptide
AEMEISTTNPVAYEGYGQCVCSNWEEPHNTENFNSDNQS

SEQ ID NO: 208406 - protein, 39 aa, Artificial Sequence
  Description of Artificial Sequence: Synthetic polypeptide
DDAEISTTNPVAYEQYGQCVCSMWGEDHNAEYFNSDTQA

SEQ ID NO: 208407 - protein, 37 aa, Artificial Sequence
  Description of Artificial Sequence: Synthetic polypeptide
AEMEISTTNPVAYEGYGCVCSNWGEPNAENFISDTQA

SEQ ID NO: 208408 - protein, 39 aa, Artificial Sequence
  Description of Artificial Sequence: Synthetic polypeptide
AEMEISTTNPVAYEGYGCIVCSNWGEDHNTENFNSENQS

SEQ ID NO: 208409 - protein, 38 aa, Artificial Sequence
  Description of Artificial Sequence: Synthetic polypeptide
DDAEISTTNPVAYEQYGQCVCGNWGEHNAENFGSETQS

SEQ ID NO: 208410 - protein, 38 aa, Artificial Sequence
  Description of Artificial Sequence: Synthetic polypeptide
AEMEISTTNPVATEYYGCVCSNWGEDPNAEFFISDTQA

SEQ ID NO: 208411 - protein, 39 aa, Artificial Sequence
  Description of Artificial Sequence: Synthetic polypeptide
AEMEISTTNPVATEQYGQCVCSNWGEDHNDEFFISDTQS

SEQ ID NO: 208412 - protein, 39 aa, Artificial Sequence
  Description of Artificial Sequence: Synthetic polypeptide
AEMEISTTNPVATEQYGQCVCGNWGEDHNAENFNSDNQA

SEQ ID NO: 208413 - protein, 39 aa, Artificial Sequence
  Description of Artificial Sequence: Synthetic polypeptide
DEMEISTTNPVAYEGYGQCVCQNWGEDTNAENFNSDNQL

SEQ ID NO: 208414 - protein, 39 aa, Artificial Sequence
  Description of Artificial Sequence: Synthetic polypeptide
DEACISTTNPVAYEQYGQCSCSNWGEDHNAENFNSDPQS

SEQ ID NO: 208415 - protein, 40 aa, Artificial Sequence
  Description of Artificial Sequence: Synthetic polypeptide
AEMEISTTNPVATEQYGQCQVCSNWGEDHNTENFNSDTQA

SEQ ID NO: 208416 - protein, 38 aa, Artificial Sequence
  Description of Artificial Sequence: Synthetic polypeptide
DEACISTTNPVAYEQYGCVCGNWGEDHNAENFNSETQS

SEQ ID NO: 208417 - protein, 39 aa, Artificial Sequence
  Description of Artificial Sequence: Synthetic polypeptide
AEMEISTTNPVATEGYGQCVCSNWGEDHNAENFNSETQF

SEQ ID NO: 208418 - protein, 39 aa, Artificial Sequence
  Description of Artificial Sequence: Synthetic polypeptide
AEMEISTTNPVATEGYGQCVCSNWGEDHNAENFNSDTQG

SEQ ID NO: 208419 - protein, 38 aa, Artificial Sequence
  Description of Artificial Sequence: Synthetic polypeptide
AEMEISTTNPVATEGYGQCTCSMWEEDNAEYINSDTQA

SEQ ID NO: 208420 - protein, 38 aa, Artificial Sequence
  Description of Artificial Sequence: Synthetic polypeptide
DEACISTTNPVAYEGYGQCVCSNWGEHNTEGFNSDTQS

SEQ ID NO: 208421 - protein, 38 aa, Artificial Sequence
  Description of Artificial Sequence: Synthetic polypeptide
DEACISTTNPVAYEGYGQCVCSNWGEHNIENFNSDTQA

SEQ ID NO: 208422 - protein, 38 aa, Artificial Sequence
  Description of Artificial Sequence: Synthetic polypeptide
DEACISTTNPVAYEGYGQCVCSNWGEHNAENFNSDTQG

SEQ ID NO: 208423 - protein, 39 aa, Artificial Sequence
  Description of Artificial Sequence: Synthetic polypeptide
DEMEISTTNPVAYEGYGQCAVCSNWGEHNAENFNSDTQS

SEQ ID NO: 208424 - protein, 40 aa, Artificial Sequence
  Description of Artificial Sequence: Synthetic polypeptide
DEACISTTNPVAYEQYGQCQVCSTWGEDHNAEYFNSENQA

SEQ ID NO: 208425 - protein, 40 aa, Artificial Sequence
  Description of Artificial Sequence: Synthetic polypeptide
DEEEIATTNPVATEQWGCTRNQANGNGVDTATANIDEEWP

SEQ ID NO: 208426 - protein, 39 aa, Artificial Sequence
  Description of Artificial Sequence: Synthetic polypeptide
DDAEISTTNPVAYEQYGQCVCSNSGEDDNAENFNSETQA

SEQ ID NO: 208427 - protein, 39 aa, Artificial Sequence
  Description of Artificial Sequence: Synthetic polypeptide
AEMEISTTNPVAYEQYGQCVCQNSGEDHNAENSNSDTQA

SEQ ID NO: 208428 - protein, 39 aa, Artificial Sequence
  Description of Artificial Sequence: Synthetic polypeptide
AEMEISTTNPVAYEQYGQCVCSNWGEDHNEENINSETQA

SEQ ID NO: 208429 - protein, 39 aa, Artificial Sequence
  Description of Artificial Sequence: Synthetic polypeptide
DEACISTTNPVAYEQYGQCVCSNWGELHNIENFNSDTQS

SEQ ID NO: 208430 - protein, 38 aa, Artificial Sequence
  Description of Artificial Sequence: Synthetic polypeptide
DEACISTTNPVAYEQYGQCVCSNWGEHNAENFISETQS

SEQ ID NO: 208431 - protein, 39 aa, Artificial Sequence
  Description of Artificial Sequence: Synthetic polypeptide
DEACISTTNPVAYEQYGQCVCSNWGEDPNAENFNSDTQS

SEQ ID NO: 208432 - protein, 39 aa, Artificial Sequence
  Description of Artificial Sequence: Synthetic polypeptide
DEACISTTNPVAYEQYGQCVCSNWGEDHNDENFNSDTQS

SEQ ID NO: 208433 - protein, 39 aa, Artificial Sequence
  Description of Artificial Sequence: Synthetic polypeptide
DEACISTTNPVAYEQYGQCVCSNWGEDHNAEYFNSETQS

SEQ ID NO: 208434 - protein, 39 aa, Artificial Sequence
  Description of Artificial Sequence: Synthetic polypeptide
DEACISTTNPVAYEQYGQCVCSNWGEDHNAEYFNSDTQS

SEQ ID NO: 208435 - protein, 39 aa, Artificial Sequence
  Description of Artificial Sequence: Synthetic polypeptide
DEACISTTNPVAYEQYGQCVCSNWGEDHNAEYFNSDNQS

SEQ ID NO: 208436 - protein, 39 aa, Artificial Sequence
  Description of Artificial Sequence: Synthetic polypeptide
AEMEISTTNPVAYEQYGQCVCSNWGEDHNAESFNSDTQS

SEQ ID NO: 208437 - protein, 39 aa, Artificial Sequence
  Description of Artificial Sequence: Synthetic polypeptide
DDAEISTTNPVAYEQYGQCVCSNSGEDHNAENFGSDTQS

SEQ ID NO: 208438 - protein, 39 aa, Artificial Sequence
  Description of Artificial Sequence: Synthetic polypeptide
DEACISTTNPVAYEQYGQCVCSNWGEDHNAENFNSDTQS

SEQ ID NO: 208439 - protein, 39 aa, Artificial Sequence
  Description of Artificial Sequence: Synthetic polypeptide
DEACISTTNPVAYEQYGQCVCSNWGEDHNAENFNSDNQL

SEQ ID NO: 208440 - protein, 39 aa, Artificial Sequence
  Description of Artificial Sequence: Synthetic polypeptide
AEMEISTTNPVAYEQYGQCVCSNWGEDHNAENFNSDTQP

SEQ ID NO: 208441 - protein, 39 aa, Artificial Sequence
  Description of Artificial Sequence: Synthetic polypeptide
DEACISTTNPVAYEQYGQCVCSNWGEDDNQEYFNSDTQS

SEQ ID NO: 208442 - protein, 39 aa, Artificial Sequence
  Description of Artificial Sequence: Synthetic polypeptide
AEMEISTTNPVAYEQYGQCVCSNWGEDDNAENFNSETQA

SEQ ID NO: 208443 - protein, 39 aa, Artificial Sequence
  Description of Artificial Sequence: Synthetic polypeptide
DEACISTTNPVAYEQYGQCVCSNWGEDDNAENFNSENQA

SEQ ID NO: 208444 - protein, 39 aa, Artificial Sequence
  Description of Artificial Sequence: Synthetic polypeptide
AEMEISTTNPVAYEQYGQCVCSMWGEDHNIENFNSDTQA

SEQ ID NO: 208445 - protein, 39 aa, Artificial Sequence
  Description of Artificial Sequence: Synthetic polypeptide
DEACISTTNPVAYEQYGQCVCQNWGEDPNIEGFNSQNQS

SEQ ID NO: 208446 - protein, 39 aa, Artificial Sequence
  Description of Artificial Sequence: Synthetic polypeptide
DDAEISTTNPVAYEQYGQCVCSNWGEDHNAEGFNSDTQA

SEQ ID NO: 208447 - protein, 39 aa, Artificial Sequence
  Description of Artificial Sequence: Synthetic polypeptide
DDAEISTTNPVAYEQYGQCVCSNWEEDHNAEYFNSDTQN

SEQ ID NO: 208448 - protein, 39 aa, Artificial Sequence
  Description of Artificial Sequence: Synthetic polypeptide
AEMEISTTNPVAYEQYGQCVCSNWGEDHNAENFNSQNQL

SEQ ID NO: 208449 - protein, 38 aa, Artificial Sequence
  Description of Artificial Sequence: Synthetic polypeptide
AENEIACTNPVATEQYGCSCSNWGEDDNAEYFISDTQS

SEQ ID NO: 208450 - protein, 40 aa, Artificial Sequence
  Description of Artificial Sequence: Synthetic polypeptide
DEEEIATTNPVATEQWGCTNNQANMNGVHTATANKDEEWP

SEQ ID NO: 208451 - protein, 40 aa, Artificial Sequence
  Description of Artificial Sequence: Synthetic polypeptide
DEEEIATTNPVATEQWGCTNNQANGNGVETATANMDEEWP

SEQ ID NO: 208452 - protein, 38 aa, Artificial Sequence
  Description of Artificial Sequence: Synthetic polypeptide
DDAEISTTNPVAYEQWGQCVCSNWGEHNAENFNSDTQA

SEQ ID NO: 208453 - protein, 38 aa, Artificial Sequence
  Description of Artificial Sequence: Synthetic polypeptide
AEMCISTTNPVAYEQYGCVCSNWEEDHNAENFNSDNQS

SEQ ID NO: 208454 - protein, 38 aa, Artificial Sequence
  Description of Artificial Sequence: Synthetic polypeptide
DEACISTTNPVAYEGYGCVCSNWGEDHNIENFNSDPQA

SEQ ID NO: 208455 - protein, 38 aa, Artificial Sequence
  Description of Artificial Sequence: Synthetic polypeptide
DEACISTTNPVAYEGYGCVCSNWGEDHNAENFNSETQA

SEQ ID NO: 208456 - protein, 39 aa, Artificial Sequence
  Description of Artificial Sequence: Synthetic polypeptide
AEMCISTTNPVATEQYGQCVCSNWGEDPNAENFGSDTQA

SEQ ID NO: 208457 - protein, 38 aa, Artificial Sequence
  Description of Artificial Sequence: Synthetic polypeptide
DEMEISTTNPVAYEGYGCVCSNWGEDPNAENFSSDTQA

SEQ ID NO: 208458 - protein, 38 aa, Artificial Sequence
  Description of Artificial Sequence: Synthetic polypeptide
DEMEISTTNPVAYEGYGCVCQNWGADHNIENFMSDTQS

SEQ ID NO: 208459 - protein, 38 aa, Artificial Sequence
  Description of Artificial Sequence: Synthetic polypeptide
DEACISTTNPVAYEEYGQCVCSNWGEHNIEGFNSDTQS

SEQ ID NO: 208460 - protein, 39 aa, Artificial Sequence
  Description of Artificial Sequence: Synthetic polypeptide
AEMCISTTNPVATEQYGQCVCQNWGEDTNAENFNSDNQL

SEQ ID NO: 208461 - protein, 38 aa, Artificial Sequence
  Description of Artificial Sequence: Synthetic polypeptide
AEMCISTTNPVAYEQYGQCVCGNWMEHNTENFNSDNQA

SEQ ID NO: 208462 - protein, 41 aa, Artificial Sequence
  Description of Artificial Sequence: Synthetic polypeptide
DVEEPTINRDTVNPVTATEAYGSVDATVTTGAQPTIVVNFP

SEQ ID NO: 208463 - protein, 36 aa, Artificial Sequence
  Description of Artificial Sequence: Synthetic polypeptide
EAAEIATVNPVAYEQWGCVTGNGNEGEQDIQGEGGQ

SEQ ID NO: 208464 - protein, 37 aa, Artificial Sequence
  Description of Artificial Sequence: Synthetic polypeptide
EAEEIATTNPVAYEQWGSICAMNNGGEPDIGGVGDMW

SEQ ID NO: 208465 - protein, 38 aa, Artificial Sequence
  Description of Artificial Sequence: Synthetic polypeptide
EAEGEIATTNPVAYEQWGTCIAVNNALTADTPGEDTRV

SEQ ID NO: 208466 - protein, 39 aa, Artificial Sequence
  Description of Artificial Sequence: Synthetic polypeptide
DDMEIRTTNPVAYEGYGQCVCSNWGEDHNEENFNSDTQA

SEQ ID NO: 208467 - protein, 39 aa, Artificial Sequence
  Description of Artificial Sequence: Synthetic polypeptide
DDMEISCTNPVATEGYGQCVCSNWGEDTNAENFNSDTQA

SEQ ID NO: 208468 - protein, 39 aa, Artificial Sequence
  Description of Artificial Sequence: Synthetic polypeptide
DDMEISCTNPVATEQYGQCVCSNWGEDHNAENFNSDTQA

SEQ ID NO: 208469 - protein, 39 aa, Artificial Sequence
  Description of Artificial Sequence: Synthetic polypeptide
DEMEISTTNPVAYEEYGQCVCSNWGEDHNAENFNSDTQS

SEQ ID NO: 208470 - protein, 39 aa, Artificial Sequence
  Description of Artificial Sequence: Synthetic polypeptide
DEMEISTTNPVAYCQYGQCVCSNWGEDHNEEYFGSDTQS

SEQ ID NO: 208471 - protein, 38 aa, Artificial Sequence
  Description of Artificial Sequence: Synthetic polypeptide
DDMEISCTNPVAYEQYGQCVCSNWGEHNAENFNSDNQG

SEQ ID NO: 208472 - protein, 39 aa, Artificial Sequence
  Description of Artificial Sequence: Synthetic polypeptide
AEMCISTTNPVATEQYGQCVCGNSGEDHNAENFNSDTQS

SEQ ID NO: 208473 - protein, 40 aa, Artificial Sequence
  Description of Artificial Sequence: Synthetic polypeptide
DEEEIATTNPVATEQWGCTNNQANMNGVEDATANIDEEWP

SEQ ID NO: 208474 - protein, 38 aa, Artificial Sequence
  Description of Artificial Sequence: Synthetic polypeptide
DDAEISTTNPVAYEQYGQCVCENWEEHNAENFNSDTQA

SEQ ID NO: 208475 - protein, 36 aa, Artificial Sequence
  Description of Artificial Sequence: Synthetic polypeptide
DTTEIRTTNPIATECWGATTWANAEDWTAEPKGPYI

SEQ ID NO: 208476 - protein, 40 aa, Artificial Sequence
  Description of Artificial Sequence: Synthetic polypeptide
DEEEIATTNPVATEQWGCTNNQANGNGVDTATANIDEEVH

SEQ ID NO: 208477 - protein, 40 aa, Artificial Sequence
  Description of Artificial Sequence: Synthetic polypeptide
DEEEIATTNPVATEQWGCTNNQANANGVDTATANSDEEWP

SEQ ID NO: 208478 - protein, 40 aa, Artificial Sequence
  Description of Artificial Sequence: Synthetic polypeptide
DEEEIATTNPVATEQWGCTNNQAAMNGVDTATANADEEWP

SEQ ID NO: 208479 - protein, 38 aa, Artificial Sequence
  Description of Artificial Sequence: Synthetic polypeptide
DEESIACTNPVAYEQWGCSVIAEANAGDNSAEGIGSLM

SEQ ID NO: 208480 - protein, 37 aa, Artificial Sequence
  Description of Artificial Sequence: Synthetic polypeptide
DEESIACTNPVAYEQWGHCAFAANGHPTEADGGNDHD

SEQ ID NO: 208481 - protein, 37 aa, Artificial Sequence
  Description of Artificial Sequence: Synthetic polypeptide
AEMEIATTNPVAYEGYGCVCSNWGEDNQEHFISETQA

SEQ ID NO: 208482 - protein, 39 aa, Artificial Sequence
  Description of Artificial Sequence: Synthetic polypeptide
DEESIASTNPVAYEPQWGHSACAAANGQDAMQAGNDQHE

SEQ ID NO: 208483 - protein, 39 aa, Artificial Sequence
  Description of Artificial Sequence: Synthetic polypeptide
AEMEIATTNPVATEQYGQCVCSNWMEDDNAEHFISETQA

SEQ ID NO: 208484 - protein, 37 aa, Artificial Sequence
  Description of Artificial Sequence: Synthetic polypeptide
AEMEIATTNPVATEGYGCYCPNWGEDNAEHFNSETQA

SEQ ID NO: 208485 - protein, 39 aa, Artificial Sequence
  Description of Artificial Sequence: Synthetic polypeptide
DDMCISTTNPVAYEQYGQCVCSNSMEDHNTENFISDNQA

SEQ ID NO: 208486 - protein, 36 aa, Artificial Sequence
  Description of Artificial Sequence: Synthetic polypeptide
AEMEIACTNPVGYEGYGCSCGNSGEHNAEHFGSDQS

SEQ ID NO: 208487 - protein, 38 aa, Artificial Sequence
  Description of Artificial Sequence: Synthetic polypeptide
AEMEIACTNPVGTEGYGQVSCGNSGEHNQEHFNSDTQS

SEQ ID NO: 208488 - protein, 38 aa, Artificial Sequence
  Description of Artificial Sequence: Synthetic polypeptide
DDMCISTTNPVATEGYGQCVCSNWGEHNAENFNSDTQS

SEQ ID NO: 208489 - protein, 39 aa, Artificial Sequence
  Description of Artificial Sequence: Synthetic polypeptide
DEESIATTNPVAYEPQWGHSACAAANGQDAMQAGADQHQ

SEQ ID NO: 208490 - protein, 39 aa, Artificial Sequence
  Description of Artificial Sequence: Synthetic polypeptide
DDMCISTTNPVATEQYGQCVCSNWGEDHNAENFNSQTQS

SEQ ID NO: 208491 - protein, 39 aa, Artificial Sequence
  Description of Artificial Sequence: Synthetic polypeptide
DDMCISTTNPVATEQYGQCVCSNWGEDHNIEGFNSDTQA

SEQ ID NO: 208492 - protein, 39 aa, Artificial Sequence
  Description of Artificial Sequence: Synthetic polypeptide
DEESIATTNPVAYEPQWGHSACAAANGQDAVQAGGDQHV

SEQ ID NO: 208493 - protein, 35 aa, Artificial Sequence
  Description of Artificial Sequence: Synthetic polypeptide
AEMEIACTNPCSYEQYGCVCSWEDNQESFISETQS

SEQ ID NO: 208494 - protein, 37 aa, Artificial Sequence
  Description of Artificial Sequence: Synthetic polypeptide
DTTAEIASTNPVAYEQWGCNVAANNGMLAPPAENADE

SEQ ID NO: 208495 - protein, 36 aa, Artificial Sequence
  Description of Artificial Sequence: Synthetic polypeptide
DTTEIATTNPIATECWGATYYANENDQHEKTIKGMS

SEQ ID NO: 208496 - protein, 38 aa, Artificial Sequence
  Description of Artificial Sequence: Synthetic polypeptide
DDMCISTTNPVATEGYGQCVCSNWEEHNAENFNSDTQS

SEQ ID NO: 208497 - protein, 39 aa, Artificial Sequence
  Description of Artificial Sequence: Synthetic polypeptide
DEACISTTNPVAYEQYGQCVCSNWMEDHNTENFNSDTQA

SEQ ID NO: 208498 - protein, 39 aa, Artificial Sequence
  Description of Artificial Sequence: Synthetic polypeptide
DEACISTTNPVAYEQYGQCVCYTWGEDHNAENFNSDTQS

SEQ ID NO: 208499 - protein, 39 aa, Artificial Sequence
  Description of Artificial Sequence: Synthetic polypeptide
AEMEISTTNPVAYEQYGQCVCSNWGEDHNIEGFNSENQS

SEQ ID NO: 208500 - protein, 37 aa, Artificial Sequence
  Description of Artificial Sequence: Synthetic polypeptide
DSNEVAATNPVSYEPYGNVVAANATISQLSTGGQNRL

SEQ ID NO: 208501 - protein, 39 aa, Artificial Sequence
  Description of Artificial Sequence: Synthetic polypeptide
DDEEISTTNPVAYEGYGCIVCSNWGEDHNTENFNSETQA

SEQ ID NO: 208502 - protein, 39 aa, Artificial Sequence
  Description of Artificial Sequence: Synthetic polypeptide
DDEAISTTNPVATEGYGQCVCSNWEEDHNAEYFNSDTQA

SEQ ID NO: 208503 - protein, 40 aa, Artificial Sequence
  Description of Artificial Sequence: Synthetic polypeptide
DEMEISTTNPVAYEQYGQCQVCSNWGEDHNAENFNSENQS

SEQ ID NO: 208504 - protein, 40 aa, Artificial Sequence
  Description of Artificial Sequence: Synthetic polypeptide
DEMEISTTNPVAYEQYGQCQVCSNSGEDHNAENFNSDTQQ

SEQ ID NO: 208505 - protein, 38 aa, Artificial Sequence
  Description of Artificial Sequence: Synthetic polypeptide
DDEEISTTNPVAYEGYGCVCSNWEEDHNEEFFPSDTQA

SEQ ID NO: 208506 - protein, 40 aa, Artificial Sequence
  Description of Artificial Sequence: Synthetic polypeptide
DEMEISTTNPVAYEQYGQCQVCGNSGEDDNIENFNSETQS

SEQ ID NO: 208507 - protein, 40 aa, Artificial Sequence
  Description of Artificial Sequence: Synthetic polypeptide
DEMEISTTNPVAYEQYGQCAVCSNWGEDHNTEGFISDNQS

SEQ ID NO: 208508 - protein, 39 aa, Artificial Sequence
  Description of Artificial Sequence: Synthetic polypeptide
DDEAISTTNPVATEGYGQCVCSNWGEDHNAENFNSDNQS

SEQ ID NO: 208509 - protein, 36 aa, Artificial Sequence
  Description of Artificial Sequence: Synthetic polypeptide
DSTEIRTTNPIATEPWGATTPACAEDWSANPTGPYI

SEQ ID NO: 208510 - protein, 39 aa, Artificial Sequence
  Description of Artificial Sequence: Synthetic polypeptide
DDEEISTTNPVAYEGYGQCVCSNSGEDDNAENFNSDTQS

SEQ ID NO: 208511 - protein, 39 aa, Artificial Sequence
  Description of Artificial Sequence: Synthetic polypeptide
DDEEISTTNPVAYEGYGQCVCSNWEEDTNIENFISDTQA

SEQ ID NO: 208512 - protein, 39 aa, Artificial Sequence
  Description of Artificial Sequence: Synthetic polypeptide
DEECIATTNPVAYEQYGQCVCSNWGEDHNAENFMSDTQS

SEQ ID NO: 208513 - protein, 39 aa, Artificial Sequence
  Description of Artificial Sequence: Synthetic polypeptide
DDEEISTTNPVAYEGYGQCVCSNWGEDHNAEGFISDNQS

SEQ ID NO: 208514 - protein, 36 aa, Artificial Sequence
  Description of Artificial Sequence: Synthetic polypeptide
DEESIACTNPVATAQWGCMCAAGAHADLNTAGMGMA

SEQ ID NO: 208515 - protein, 39 aa, Artificial Sequence
  Description of Artificial Sequence: Synthetic polypeptide
DDEEISTTNPVAYEGYGQCVCSNWGEDHNAENFNSDTQP

SEQ ID NO: 208516 - protein, 39 aa, Artificial Sequence
  Description of Artificial Sequence: Synthetic polypeptide
DDEEISTTNPVAYEGYGQCVCSNWGEDHNAEYFNSETQS

SEQ ID NO: 208517 - protein, 41 aa, Artificial Sequence
  Description of Artificial Sequence: Synthetic polypeptide
DTEEICTIQTTTNVTTNCATEQYGVVVVVSTQQLVTGNNIL

SEQ ID NO: 208518 - protein, 39 aa, Artificial Sequence
  Description of Artificial Sequence: Synthetic polypeptide
DDEEISTTNPVAYEGYGQCVCSNWGEEHNAENFISDNQS

SEQ ID NO: 208519 - protein, 38 aa, Artificial Sequence
  Description of Artificial Sequence: Synthetic polypeptide
DDEEISTTNPVAYEGYGQCVCSNWGEHNAENFFSETQA

SEQ ID NO: 208520 - protein, 39 aa, Artificial Sequence
  Description of Artificial Sequence: Synthetic polypeptide
DDEEISTTNPVAYEGYGQCVCSNWEEDHNAEGFNSDTQF

SEQ ID NO: 208521 - protein, 38 aa, Artificial Sequence
  Description of Artificial Sequence: Synthetic polypeptide
DDEEISTTNPVAYEGYGQCVCSNWGEHNAENFISDTQS

SEQ ID NO: 208522 - protein, 35 aa, Artificial Sequence
  Description of Artificial Sequence: Synthetic polypeptide
DSTEIRTTNPIATECWGATTWARAEDWAEPKGPYI

SEQ ID NO: 208523 - protein, 40 aa, Artificial Sequence
  Description of Artificial Sequence: Synthetic polypeptide
DEMEISTTNPVAYEQYGQCQVCSNWGEDHNTENFNSDTQS

SEQ ID NO: 208524 - protein, 37 aa, Artificial Sequence
  Description of Artificial Sequence: Synthetic polypeptide
DSSEVASTNPVSYEPYGNVVAANASISQDSTGGQNRL

SEQ ID NO: 208525 - protein, 38 aa, Artificial Sequence
  Description of Artificial Sequence: Synthetic polypeptide
DSSEVASTNPVSYEPYGNVVAANALEISQMSTGGQNRL

SEQ ID NO: 208526 - protein, 37 aa, Artificial Sequence
  Description of Artificial Sequence: Synthetic polypeptide
DSSEVASTNPVSYEPYGKVVAYNATISQISVGGQNRL

SEQ ID NO: 208527 - protein, 37 aa, Artificial Sequence
  Description of Artificial Sequence: Synthetic polypeptide
DSSEVASTNPVSYEPYGNVVAANATVSQMSTGGQNRS

SEQ ID NO: 208528 - protein, 37 aa, Artificial Sequence
  Description of Artificial Sequence: Synthetic polypeptide
DSSEVASTNPVSYEPYGNVVAANTHISQISVSGDNRL

SEQ ID NO: 208529 - protein, 36 aa, Artificial Sequence
  Description of Artificial Sequence: Synthetic polypeptide
DSSEVASTNPVSYEGYGNVVACNTISQSQVGGQNSK

SEQ ID NO: 208530 - protein, 37 aa, Artificial Sequence
  Description of Artificial Sequence: Synthetic polypeptide
DSSEVASTNPVSYEAYGNVVAANATISQMSTDGQNRL

SEQ ID NO: 208531 - protein, 37 aa, Artificial Sequence
  Description of Artificial Sequence: Synthetic polypeptide
DSSEVASTNPVSYEPYGNVVAANTTTSQISTGGQNRL

SEQ ID NO: 208532 - protein, 39 aa, Artificial Sequence
  Description of Artificial Sequence: Synthetic polypeptide
DDEAISTTNPCATEQYGQCVCSNWGEDHNQENFNSQTQS

SEQ ID NO: 208533 - protein, 39 aa, Artificial Sequence
  Description of Artificial Sequence: Synthetic polypeptide
DDEEISTTNPVAYEEYGQCVCSNSGEDHNAESFNSDTAA

SEQ ID NO: 208534 - protein, 37 aa, Artificial Sequence
  Description of Artificial Sequence: Synthetic polypeptide
DSSEVASTNPVSYEPYGNVVAAWMTISQISTGGQNRL

SEQ ID NO: 208535 - protein, 39 aa, Artificial Sequence
  Description of Artificial Sequence: Synthetic polypeptide
DEMEISTTNPVAYEQYGQCVCGNWGEDPNIENFNSETQS

SEQ ID NO: 208536 - protein, 38 aa, Artificial Sequence
  Description of Artificial Sequence: Synthetic polypeptide
DEAEIACTNPVATEQWGCTHNAANDGANGSPAEAGNTW

SEQ ID NO: 208537 - protein, 37 aa, Artificial Sequence
  Description of Artificial Sequence: Synthetic polypeptide
DSSEVASTNPVSYEPYGNVVACAATISQMSTGGQNRL

SEQ ID NO: 208538 - protein, 37 aa, Artificial Sequence
  Description of Artificial Sequence: Synthetic polypeptide
DSSEVASTNPVSYEPYGNVVAPNATISQMSTGGQNRY

SEQ ID NO: 208539 - protein, 37 aa, Artificial Sequence
  Description of Artificial Sequence: Synthetic polypeptide
DSSEVASTNPVSYEPYGNVVAVNTTGSQISDGGQNRD

SEQ ID NO: 208540 - protein, 37 aa, Artificial Sequence
  Description of Artificial Sequence: Synthetic polypeptide
DSSEVASTNPVSYEPYGNVVVANETISQISTGGQNRL

SEQ ID NO: 208541 - protein, 37 aa, Artificial Sequence
  Description of Artificial Sequence: Synthetic polypeptide
DSSEVASTNPVSYEPYGYVVAANATISQMSTGGPNRL

SEQ ID NO: 208542 - protein, 37 aa, Artificial Sequence
  Description of Artificial Sequence: Synthetic polypeptide
DSSEVQSTNPVSYEPYGNVVAANATISQESTGGQNRL

SEQ ID NO: 208543 - protein, 39 aa, Artificial Sequence
  Description of Artificial Sequence: Synthetic polypeptide
DDEEISTTNPVAYEAYGQCVCSNWGEDHNAENFNSDTQG

SEQ ID NO: 208544 - protein, 37 aa, Artificial Sequence
  Description of Artificial Sequence: Synthetic polypeptide
DSSEMASTNPVSYEPYGNVVAANATISQWSTGGQNRL

SEQ ID NO: 208545 - protein, 40 aa, Artificial Sequence
  Description of Artificial Sequence: Synthetic polypeptide
DDEAISTTNPVATEQYGQCAVCSNWGEAHNAENFNSDTQA

SEQ ID NO: 208546 - protein, 39 aa, Artificial Sequence
  Description of Artificial Sequence: Synthetic polypeptide
DDEEISTTNPVAYEGYGQCVCSNWMEDHNAENFNSETQA

SEQ ID NO: 208547 - protein, 39 aa, Artificial Sequence
  Description of Artificial Sequence: Synthetic polypeptide
DEMEISTTNPVAYEQYGQCVCSNWGEDPNAENFISDTQA

SEQ ID NO: 208548 - protein, 39 aa, Artificial Sequence
  Description of Artificial Sequence: Synthetic polypeptide
DEMEISTTNPVAYEGYGQCVCSNWGEDHNAENFISENQS

SEQ ID NO: 208549 - protein, 39 aa, Artificial Sequence
  Description of Artificial Sequence: Synthetic polypeptide
DEMEISTTNPVAYEGYGQCVCSNWGEDHNAEGFNSETQG

SEQ ID NO: 208550 - protein, 39 aa, Artificial Sequence
  Description of Artificial Sequence: Synthetic polypeptide
DEMEISTTNPVAYEGYGQCVCSNSGEDHNAENFNSDTQA

SEQ ID NO: 208551 - protein, 38 aa, Artificial Sequence
  Description of Artificial Sequence: Synthetic polypeptide
AENCIATTNPVATEGYGQCVCSTWGEDNAEHFISETQA

SEQ ID NO: 208552 - protein, 37 aa, Artificial Sequence
  Description of Artificial Sequence: Synthetic polypeptide
AENCIATTNPVATEGYGCVCSWGEDHNQEHFISETQA

SEQ ID NO: 208553 - protein, 39 aa, Artificial Sequence
  Description of Artificial Sequence: Synthetic polypeptide
DEEAISTTNPVAYEYYGQCVCSNWGEDHNAEHFNSDTQA

SEQ ID NO: 208554 - protein, 39 aa, Artificial Sequence
  Description of Artificial Sequence: Synthetic polypeptide
DEEAISTTNPVAYEQYGQCVCSNWGEDHNAENFISEFQA

SEQ ID NO: 208555 - protein, 39 aa, Artificial Sequence
  Description of Artificial Sequence: Synthetic polypeptide
DEEAISTTNPVAYEQYGQCVCGNWGEDHNAEYFNSDTQA

SEQ ID NO: 208556 - protein, 39 aa, Artificial Sequence
  Description of Artificial Sequence: Synthetic polypeptide
DEEAISTTNPVAYEQYGQCVCGNWGEDHNAENFGSDTQP

SEQ ID NO: 208557 - protein, 39 aa, Artificial Sequence
  Description of Artificial Sequence: Synthetic polypeptide
DEMEISTTNPVAYEGYGQCVCSNWGEDHNAENFNSDNQA

SEQ ID NO: 208558 - protein, 39 aa, Artificial Sequence
  Description of Artificial Sequence: Synthetic polypeptide
DEEAISTTNPVAYEGYGQCVCSNWGEDHNQEYFNSETQA

SEQ ID NO: 208559 - protein, 39 aa, Artificial Sequence
  Description of Artificial Sequence: Synthetic polypeptide
DEEAISTTNPVAYEGYGQCVCSNWGEDHNAENFNSDTQS

SEQ ID NO: 208560 - protein, 39 aa, Artificial Sequence
  Description of Artificial Sequence: Synthetic polypeptide
DEEAISTTNPVAYEGYGQCVCSNWGEDDNAENFNSDNQM

SEQ ID NO: 208561 - protein, 37 aa, Artificial Sequence
  Description of Artificial Sequence: Synthetic polypeptide
AENAIATTNPVATEGYGCVCSNWGEDNQEHFISETQA

SEQ ID NO: 208562 - protein, 38 aa, Artificial Sequence
  Description of Artificial Sequence: Synthetic polypeptide
CETEIACTNPVATEQWGTCCFATNGQNPETLENGEEAS

SEQ ID NO: 208563 - protein, 39 aa, Artificial Sequence
  Description of Artificial Sequence: Synthetic polypeptide
AEMEISTTNPVAYEQYGQCVCSNWGEDHNTESFNSDTQS

SEQ ID NO: 208564 - protein, 38 aa, Artificial Sequence
  Description of Artificial Sequence: Synthetic polypeptide
DDAEISTTNPVAYEQYGQCVCSNWGEHNAENFISDTQA

SEQ ID NO: 208565 - protein, 38 aa, Artificial Sequence
  Description of Artificial Sequence: Synthetic polypeptide
DEACISTVNPVATEGYGCVCSNWGEDHNEENFGSDTQS

SEQ ID NO: 208566 - protein, 39 aa, Artificial Sequence
  Description of Artificial Sequence: Synthetic polypeptide
AEMEISTTNPVAYEQYGQCVCSNWGEDHNIENFNSQNQS

SEQ ID NO: 208567 - protein, 40 aa, Artificial Sequence
  Description of Artificial Sequence: Synthetic polypeptide
DEEEIRTTNPVAYDAEQGNCIVRNTPWHLPEGQIEVSQYM

SEQ ID NO: 208568 - protein, 35 aa, Artificial Sequence
  Description of Artificial Sequence: Synthetic polypeptide
AENASESTTNPVAYESWGTVYQPNGNGPPTGSNDH

SEQ ID NO: 208569 - protein, 39 aa, Artificial Sequence
  Description of Artificial Sequence: Synthetic polypeptide
DEMEISTTNPVAYEGYGQCVCSNWGEDHNAENFNSDNQM

SEQ ID NO: 208570 - protein, 39 aa, Artificial Sequence
  Description of Artificial Sequence: Synthetic polypeptide
DEMEISTTNPVAYEGYGQCVCSNWGEDHNAENFNSDNQS

SEQ ID NO: 208571 - protein, 39 aa, Artificial Sequence
  Description of Artificial Sequence: Synthetic polypeptide
DEMEISTTNPVAYEGYGQCVCSNWGEDHNAENFNSDPQL

SEQ ID NO: 208572 - protein, 39 aa, Artificial Sequence
  Description of Artificial Sequence: Synthetic polypeptide
DDEEISTTNPVAYEHYGQCVCSNWGEDHNAEYFNSETQS

SEQ ID NO: 208573 - protein, 39 aa, Artificial Sequence
  Description of Artificial Sequence: Synthetic polypeptide
DDEAISTTNPVATEQYGQCVCSNWGEDHNAENFISDTQA

SEQ ID NO: 208574 - protein, 39 aa, Artificial Sequence
  Description of Artificial Sequence: Synthetic polypeptide
DDEAISTTNPVATEQYGQCVCSNWGEDHNQENFPSDTQA

SEQ ID NO: 208575 - protein, 40 aa, Artificial Sequence
  Description of Artificial Sequence: Synthetic polypeptide
DDEAKEIVCATNPVVATEQYGQSTVVCCHELSTGTVLEDF

SEQ ID NO: 208576 - protein, 38 aa, Artificial Sequence
  Description of Artificial Sequence: Synthetic polypeptide
AENCISTTNPVAYEQYGQCVCSNWGEHNAENSNSDFQS

SEQ ID NO: 208577 - protein, 39 aa, Artificial Sequence
  Description of Artificial Sequence: Synthetic polypeptide
DEMEISTTNPVAYEQWGQCVCSNWGEDHNAENFNSDNQS

SEQ ID NO: 208578 - protein, 38 aa, Artificial Sequence
  Description of Artificial Sequence: Synthetic polypeptide
DEMEISTTNPVAYEQWGCVCSNSGEDHNAEYSISDTAS

SEQ ID NO: 208579 - protein, 39 aa, Artificial Sequence
  Description of Artificial Sequence: Synthetic polypeptide
DEAEIACTNPVATAQWGNVNNNAGESGGTNQPDQMPDDH

SEQ ID NO: 208580 - protein, 38 aa, Artificial Sequence
  Description of Artificial Sequence: Synthetic polypeptide
DEMEISTTNPVAYEGYGQCVCSNWGEPNAEYFISDTQA

SEQ ID NO: 208581 - protein, 40 aa, Artificial Sequence
  Description of Artificial Sequence: Synthetic polypeptide
DDEEISTTNPVAYEQYGQCQVCSNWGEDDNAENFNSDPQS

SEQ ID NO: 208582 - protein, 39 aa, Artificial Sequence
  Description of Artificial Sequence: Synthetic polypeptide
DDEEISTTNPVAYEQYGQCVCGNWGEDHNAENFNSDTQA

SEQ ID NO: 208583 - protein, 39 aa, Artificial Sequence
  Description of Artificial Sequence: Synthetic polypeptide
AENCISTTNPVAYEQYGQCVCSNWEEEHNAENFQSDNQA

SEQ ID NO: 208584 - protein, 39 aa, Artificial Sequence
  Description of Artificial Sequence: Synthetic polypeptide
DEMEISTTNPVAYEGYGQCVCSNWGEDPNAEFFNSDTQA

SEQ ID NO: 208585 - protein, 39 aa, Artificial Sequence
  Description of Artificial Sequence: Synthetic polypeptide
DEMEISTTNPVAYEGYGQCVCSNWGEDHNAESFNSENQS

SEQ ID NO: 208586 - protein, 39 aa, Artificial Sequence
  Description of Artificial Sequence: Synthetic polypeptide
DEMEISTTNPVAYEGYGQCVCSNWGEDHNAENFNSDTQS

SEQ ID NO: 208587 - protein, 39 aa, Artificial Sequence
  Description of Artificial Sequence: Synthetic polypeptide
DDEEISTTNPVAYEQYGQCVCSNWGEDHNAEGFPSDTQS

SEQ ID NO: 208588 - protein, 39 aa, Artificial Sequence
  Description of Artificial Sequence: Synthetic polypeptide
DEMEISTTNPVAYEGYGQCVCSNWGEDHNAENFNSDTQG

SEQ ID NO: 208589 - protein, 39 aa, Artificial Sequence
  Description of Artificial Sequence: Synthetic polypeptide
DEMEISTTNPVAYEGYGQCVCSNWGEDHNAENFNSDTQA

SEQ ID NO: 208590 - protein, 38 aa, Artificial Sequence
  Description of Artificial Sequence: Synthetic polypeptide
AENEIACTNPVATEQWGCSCSNWGEDDNQEYFGSDTQA

SEQ ID NO: 208591 - protein, 39 aa, Artificial Sequence
  Description of Artificial Sequence: Synthetic polypeptide
DEMEISTTNPVAYEGYGQCVCSNWGEDHNAENFNSDPQS

SEQ ID NO: 208592 - protein, 39 aa, Artificial Sequence
  Description of Artificial Sequence: Synthetic polypeptide
DSEEIRTTNPVGYEQWGQCVCSNWGEDHNAENFNSVTQA

SEQ ID NO: 208593 - protein, 38 aa, Artificial Sequence
  Description of Artificial Sequence: Synthetic polypeptide
AEMCISTTNPVATEGYGCVCSNWGEDPNAEFFNSDTQA

SEQ ID NO: 208594 - protein, 34 aa, Artificial Sequence
  Description of Artificial Sequence: Synthetic polypeptide
TEAEIASTNPVGTEAWGVCAPTDRDQHQQQHQDS

SEQ ID NO: 208595 - protein, 38 aa, Artificial Sequence
  Description of Artificial Sequence: Synthetic polypeptide
SEEEIATTNPVAYEQYGCSCPNWGADDNAEHFISETQS

SEQ ID NO: 208596 - protein, 37 aa, Artificial Sequence
  Description of Artificial Sequence: Synthetic polypeptide
EEAAEIATVNPVAYEQWGTCVTGNGNEGEQDIQGEGQ

SEQ ID NO: 208597 - protein, 39 aa, Artificial Sequence
  Description of Artificial Sequence: Synthetic polypeptide
DDAEISTTNPVATEQYGQCVCSNWGEDHNAENFISDTQA

SEQ ID NO: 208598 - protein, 39 aa, Artificial Sequence
  Description of Artificial Sequence: Synthetic polypeptide
AEEEISTTNPVAYEGYGQCVCSNWGEDHNAESFNSDTQL

SEQ ID NO: 208599 - protein, 39 aa, Artificial Sequence
  Description of Artificial Sequence: Synthetic polypeptide
CEEEISTTNPVATEGYGQCVCSNWGEDHNEENFISDTQS

SEQ ID NO: 208600 - protein, 39 aa, Artificial Sequence
  Description of Artificial Sequence: Synthetic polypeptide
DDECISTTNPVATEQYGQCVCQNWGEDHNAEGFISETQA

SEQ ID NO: 208601 - protein, 39 aa, Artificial Sequence
  Description of Artificial Sequence: Synthetic polypeptide
AEEEISTTNPVAYEGYGQCVCSNWGEDHNAENFSSENQS

SEQ ID NO: 208602 - protein, 39 aa, Artificial Sequence
  Description of Artificial Sequence: Synthetic polypeptide
AEEEISTTNPVAYEGYGQCVCSNWGEDHNAENFNSETQA

SEQ ID NO: 208603 - protein, 39 aa, Artificial Sequence
  Description of Artificial Sequence: Synthetic polypeptide
DEACISTTNPCATEQYGQCVCSNWGEDHNAENFNSDTQA

SEQ ID NO: 208604 - protein, 39 aa, Artificial Sequence
  Description of Artificial Sequence: Synthetic polypeptide
AEEEISTTNPVAYEGYGQCVCSNWGEDHNAENFGSETQA

SEQ ID NO: 208605 - protein, 39 aa, Artificial Sequence
  Description of Artificial Sequence: Synthetic polypeptide
AEEEISTTNPVAYEGYGQCVCSNWGEDDNQEYFGSDTQS

SEQ ID NO: 208606 - protein, 39 aa, Artificial Sequence
  Description of Artificial Sequence: Synthetic polypeptide
AEEEISTTNPVAYEGYGQCVCSNWGEDHNIEHFNSDFQS

SEQ ID NO: 208607 - protein, 39 aa, Artificial Sequence
  Description of Artificial Sequence: Synthetic polypeptide
AEEEISTTNPVAYEGYGQCVCSNWGEDDNAENFNSDTQS

SEQ ID NO: 208608 - protein, 39 aa, Artificial Sequence
  Description of Artificial Sequence: Synthetic polypeptide
DDAEISTTNPVATEQYGQCVCSNWGEDHNAEHFISETQS

SEQ ID NO: 208609 - protein, 40 aa, Artificial Sequence
  Description of Artificial Sequence: Synthetic polypeptide
CEEEISTTNPVATEGYGQCQVCSNWGEDHNAEYFNSDTQA

SEQ ID NO: 208610 - protein, 39 aa, Artificial Sequence
  Description of Artificial Sequence: Synthetic polypeptide
DEACISTTNPCATEQYGQCVCQNSGEDHNAENFNSDTQA

SEQ ID NO: 208611 - protein, 39 aa, Artificial Sequence
  Description of Artificial Sequence: Synthetic polypeptide
AEEEISTTNPVAYEGYGQCVCSNWGEDDNAENFNSDTQA

SEQ ID NO: 208612 - protein, 39 aa, Artificial Sequence
  Description of Artificial Sequence: Synthetic polypeptide
AEEEISTTNPVAYEGYGQCVCSNWGEDDNAENFNSDFQA

SEQ ID NO: 208613 - protein, 37 aa, Artificial Sequence
  Description of Artificial Sequence: Synthetic polypeptide
DEACISTTNGVAYCQYGCVCSWGEDHNQENFGSDTQA

SEQ ID NO: 208614 - protein, 39 aa, Artificial Sequence
  Description of Artificial Sequence: Synthetic polypeptide
DEDVVIATTNPVAYEQWGCNVAANNGQHGQMQAGANPNM

SEQ ID NO: 208615 - protein, 37 aa, Artificial Sequence
  Description of Artificial Sequence: Synthetic polypeptide
DEDTACVTEIATNPVAYEQWGSTYINDNHEQGQQNMG

SEQ ID NO: 208616 - protein, 40 aa, Artificial Sequence
  Description of Artificial Sequence: Synthetic polypeptide
DDAEISTTNPVATEQYGQCQVCSNWGEDHNTENFISDTQA

SEQ ID NO: 208617 - protein, 39 aa, Artificial Sequence
  Description of Artificial Sequence: Synthetic polypeptide
CEEEISTTNPVATEGYGQCVCSNWGEDHDIEHFNSDTQS

SEQ ID NO: 208618 - protein, 39 aa, Artificial Sequence
  Description of Artificial Sequence: Synthetic polypeptide
AEEEISTTNPVAYEGYGQCVCSNWEEDHNTEHFNSDTQG

SEQ ID NO: 208619 - protein, 39 aa, Artificial Sequence
  Description of Artificial Sequence: Synthetic polypeptide
DDREISTTNPVAYEQYGQCVCSNWPEDHNAENFNSDTQS

SEQ ID NO: 208620 - protein, 39 aa, Artificial Sequence
  Description of Artificial Sequence: Synthetic polypeptide
AEEEISTTNPVAYEGYGQCVCSNWGEDHNIESFSSENQS

SEQ ID NO: 208621 - protein, 39 aa, Artificial Sequence
  Description of Artificial Sequence: Synthetic polypeptide
SEEEIACTNPVATEQWGHVVAAAGGAGGENTPDANDSRM

SEQ ID NO: 208622 - protein, 38 aa, Artificial Sequence
  Description of Artificial Sequence: Synthetic polypeptide
SEEEIACTNPVATEQWGHVCAAGGAGGENTPDVNDSSM

SEQ ID NO: 208623 - protein, 38 aa, Artificial Sequence
  Description of Artificial Sequence: Synthetic polypeptide
AEEEISTTNPVAYEGYGQCVCYNWGEHNTENFNSETQA

SEQ ID NO: 208624 - protein, 39 aa, Artificial Sequence
  Description of Artificial Sequence: Synthetic polypeptide
DEACISTTNPVATEGYGCQVCSNWGEDHNAENFNSETQS

SEQ ID NO: 208625 - protein, 39 aa, Artificial Sequence
  Description of Artificial Sequence: Synthetic polypeptide
DEACISTTNPVATEEYGQCVCSNWEEDDNAENFNSDFQS

SEQ ID NO: 208626 - protein, 38 aa, Artificial Sequence
  Description of Artificial Sequence: Synthetic polypeptide
AEEEISTTNPVAYEGYGQCVCSNWGEHNAENFFSETQS

SEQ ID NO: 208627 - protein, 39 aa, Artificial Sequence
  Description of Artificial Sequence: Synthetic polypeptide
DEACISTTNPVATEAYGQCVCSNWGEDHNAENFNSETQS

SEQ ID NO: 208628 - protein, 39 aa, Artificial Sequence
  Description of Artificial Sequence: Synthetic polypeptide
DEACISTTNPVATEAYGQCVCSNWGEDHNAENFNSDTQS

SEQ ID NO: 208629 - protein, 39 aa, Artificial Sequence
  Description of Artificial Sequence: Synthetic polypeptide
DDEEIRTTNPVAYEGYGQCVCGNWGEDHNAENFNSDNQM

SEQ ID NO: 208630 - protein, 39 aa, Artificial Sequence
  Description of Artificial Sequence: Synthetic polypeptide
DDREISTTNPVAYEEYGQCVCSNWGEDTNAENFNSETQS

SEQ ID NO: 208631 - protein, 37 aa, Artificial Sequence
  Description of Artificial Sequence: Synthetic polypeptide
DEAEIATTNPIATECWGATTSANATDGPAEPKGSPVN

SEQ ID NO: 208632 - protein, 37 aa, Artificial Sequence
  Description of Artificial Sequence: Synthetic polypeptide
DEAEIATTNPIATECWGATYYANFNDHQHEKTGKGMS

SEQ ID NO: 208633 - protein, 39 aa, Artificial Sequence
  Description of Artificial Sequence: Synthetic polypeptide
DEEAIGTTNPVAYEGYGQCVCQNWGEGHNAENFNSDTQE

SEQ ID NO: 208634 - protein, 40 aa, Artificial Sequence
  Description of Artificial Sequence: Synthetic polypeptide
DDECISTTNPVATEQYGQCQVCSNWEEDPNQENFNSDTQS

SEQ ID NO: 208635 - protein, 40 aa, Artificial Sequence
  Description of Artificial Sequence: Synthetic polypeptide
DDECISTTNPVATEQYGQCQVCSNWGEDDNIENFNSDNQS

SEQ ID NO: 208636 - protein, 39 aa, Artificial Sequence
  Description of Artificial Sequence: Synthetic polypeptide
DDAEISTTNPVATEQYGQCVCSNWGEDHNAENFSSETQS

SEQ ID NO: 208637 - protein, 40 aa, Artificial Sequence
  Description of Artificial Sequence: Synthetic polypeptide
DDECISTTNPVATEQYGQCQVCSNWGYDHNQENFNSETQA

SEQ ID NO: 208638 - protein, 39 aa, Artificial Sequence
  Description of Artificial Sequence: Synthetic polypeptide
DDECISTTNPVATEQYGQCVCGNWGEDHNAEYFNSDTQS

SEQ ID NO: 208639 - protein, 39 aa, Artificial Sequence
  Description of Artificial Sequence: Synthetic polypeptide
DDRCISTTNPVATEQYGQCVCSNWEEDDNAENFNSDNQA

SEQ ID NO: 208640 - protein, 39 aa, Artificial Sequence
  Description of Artificial Sequence: Synthetic polypeptide
AEEEISTTNPVAYEGYGQCVCSNWGEDHNTENFTSDTQA

SEQ ID NO: 208641 - protein, 39 aa, Artificial Sequence
  Description of Artificial Sequence: Synthetic polypeptide
DQEEISTTNPVAYCQYGQCVCSNWGEGDNAENFGSDTQS

SEQ ID NO: 208642 - protein, 38 aa, Artificial Sequence
  Description of Artificial Sequence: Synthetic polypeptide
SEEEIACTNPVATEQWGHVVAAIGAGGENTPDVNDSMM

SEQ ID NO: 208643 - protein, 40 aa, Artificial Sequence
  Description of Artificial Sequence: Synthetic polypeptide
DDAEISTTNPVATEQYGQCAVCSNWGEDPNAEYFNSDNQS

SEQ ID NO: 208644 - protein, 39 aa, Artificial Sequence
  Description of Artificial Sequence: Synthetic polypeptide
AEEEISTTNPVAYEGYGQCVCSNWEADHNAENFNSETQA

SEQ ID NO: 208645 - protein, 39 aa, Artificial Sequence
  Description of Artificial Sequence: Synthetic polypeptide
SEECISTTNPVAYEQYGQCVCSNWGEDPNAENFNSETQA

SEQ ID NO: 208646 - protein, 39 aa, Artificial Sequence
  Description of Artificial Sequence: Synthetic polypeptide
SEECISTTNPVAYEQYGQCVCSNWGEDHNTENFNSDTQA

SEQ ID NO: 208647 - protein, 39 aa, Artificial Sequence
  Description of Artificial Sequence: Synthetic polypeptide
SEECISTTNPVAYEQYGQCVCSNWGEDHNAEGFNSDTQG

SEQ ID NO: 208648 - protein, 38 aa, Artificial Sequence
  Description of Artificial Sequence: Synthetic polypeptide
SEECISTTNPVAYEGYGQCVCSNWGEHNAENFNSDNQS

SEQ ID NO: 208649 - protein, 39 aa, Artificial Sequence
  Description of Artificial Sequence: Synthetic polypeptide
DDAEISTTNPVATEGYGQCVCSNWGEDDNAENFNSDTQA

SEQ ID NO: 208650 - protein, 38 aa, Artificial Sequence
  Description of Artificial Sequence: Synthetic polypeptide
SEECISTTNPVAYEGYGQCVCSNWGEHNAENFNSDNQL

SEQ ID NO: 208651 - protein, 39 aa, Artificial Sequence
  Description of Artificial Sequence: Synthetic polypeptide
SEECISTTNPVAYEGYGQCVCSNWGEDTNAENFNSDTQA

SEQ ID NO: 208652 - protein, 39 aa, Artificial Sequence
  Description of Artificial Sequence: Synthetic polypeptide
DDAEISTTNPVATEGYGQCVCSNWEEDHNAEYFNSDTQS

SEQ ID NO: 208653 - protein, 39 aa, Artificial Sequence
  Description of Artificial Sequence: Synthetic polypeptide
DICERCKRTTTHMFPRVWWVQQQGDVEVTNRLQARFRNR

SEQ ID NO: 208654 - protein, 37 aa, Artificial Sequence
  Description of Artificial Sequence: Synthetic polypeptide
SEECISTVNPVATEGYGCVCSNWGEHNEENFISDTQS

SEQ ID NO: 208655 - protein, 39 aa, Artificial Sequence
  Description of Artificial Sequence: Synthetic polypeptide
DDAEISTTNPVATEGYGQCVCSMWGEDHNAENFNSDTQF

SEQ ID NO: 208656 - protein, 39 aa, Artificial Sequence
  Description of Artificial Sequence: Synthetic polypeptide
DDAEISTTNPVATEGYGQCVCFTWGEDHNIENFFSENQA

SEQ ID NO: 208657 - protein, 38 aa, Artificial Sequence
  Description of Artificial Sequence: Synthetic polypeptide
DDAEISTTNPVATEGYGCVCGNWEEDHNAENFNSETQA

SEQ ID NO: 208658 - protein, 38 aa, Artificial Sequence
  Description of Artificial Sequence: Synthetic polypeptide
DDAEISTTNPCAYEQYGQCVCSNWGEHNAENFNSDTQL

SEQ ID NO: 208659 - protein, 39 aa, Artificial Sequence
  Description of Artificial Sequence: Synthetic polypeptide
DEEEISTTNPVAYEHYGQCVCSNWGEDHNAENFISDTQS

SEQ ID NO: 208660 - protein, 39 aa, Artificial Sequence
  Description of Artificial Sequence: Synthetic polypeptide
DEEEISTTNPVAYEGYGQCVCYNWGEDHNAENFNSDNQG

SEQ ID NO: 208661 - protein, 38 aa, Artificial Sequence
  Description of Artificial Sequence: Synthetic polypeptide
DEMEISTTNPVATEGYGQCVCQWGADHNAENFMSDTQS

SEQ ID NO: 208662 - protein, 39 aa, Artificial Sequence
  Description of Artificial Sequence: Synthetic polypeptide
DEEEISTTNPVAYEGYGQCVCSNWGEDHNAENFISETQA

SEQ ID NO: 208663 - protein, 39 aa, Artificial Sequence
  Description of Artificial Sequence: Synthetic polypeptide
DEEEISTTNPVAYEGYGQCVCSNWGEDHNAENFISDTQS

SEQ ID NO: 208664 - protein, 39 aa, Artificial Sequence
  Description of Artificial Sequence: Synthetic polypeptide
DEEEISTTNPVAYEGYGQCVCSNWGEDHNAENFISDFQP

SEQ ID NO: 208665 - protein, 38 aa, Artificial Sequence
  Description of Artificial Sequence: Synthetic polypeptide
DDAEISTTNPVATEGYGQCVCGNWEEHNAENFQSETQA

SEQ ID NO: 208666 - protein, 39 aa, Artificial Sequence
  Description of Artificial Sequence: Synthetic polypeptide
AEEEISTTNPVAYEGYGQCVCSNWEEDHNAENFNSDTQA

SEQ ID NO: 208667 - protein, 38 aa, Artificial Sequence
  Description of Artificial Sequence: Synthetic polypeptide
SEECVRCTNPVATEQYGCVCSNWGEDHDAEYINSDTQS

SEQ ID NO: 208668 - protein, 39 aa, Artificial Sequence
  Description of Artificial Sequence: Synthetic polypeptide
DDAEISTTNPVATEGYGQCVCSNWGEDHNAEGFNSQTQA

SEQ ID NO: 208669 - protein, 38 aa, Artificial Sequence
  Description of Artificial Sequence: Synthetic polypeptide
DQAEISTTNPVAYEQYGCSCSNWGEDHNAEHFISDTQA

SEQ ID NO: 208670 - protein, 39 aa, Artificial Sequence
  Description of Artificial Sequence: Synthetic polypeptide
AEEEISTTNPVAYEGYGQCVCSNSGEDDNAENFNSDTQS

SEQ ID NO: 208671 - protein, 39 aa, Artificial Sequence
  Description of Artificial Sequence: Synthetic polypeptide
AEEEISTTNPVAYEGYGQCVCSNSGEDDNAENFNSDPQS

SEQ ID NO: 208672 - protein, 39 aa, Artificial Sequence
  Description of Artificial Sequence: Synthetic polypeptide
AEEEISTTNPVAYEGYGQCVCSMWGEDDNAENFNSDNQA

SEQ ID NO: 208673 - protein, 38 aa, Artificial Sequence
  Description of Artificial Sequence: Synthetic polypeptide
DQAEISTTNPVATEQYGCCCQNWGEDHNAEHFGSDTQA

SEQ ID NO: 208674 - protein, 38 aa, Artificial Sequence
  Description of Artificial Sequence: Synthetic polypeptide
DQAEISTTNPVATEQWGCCCSNWGEDHNAEHFNSDTQA

SEQ ID NO: 208675 - protein, 38 aa, Artificial Sequence
  Description of Artificial Sequence: Synthetic polypeptide
AEEEISTTNPVAYEGYGQCVCQNWGEHNAENFNSDNQF

SEQ ID NO: 208676 - protein, 38 aa, Artificial Sequence
  Description of Artificial Sequence: Synthetic polypeptide
DDAEISTTNPVATEGYGQCVCSNWGEHNAENFISETQA

SEQ ID NO: 208677 - protein, 39 aa, Artificial Sequence
  Description of Artificial Sequence: Synthetic polypeptide
AEEEISTTNPVAYEGYGQCVCGNWGEDDNAEGFNSDTQA

SEQ ID NO: 208678 - protein, 39 aa, Artificial Sequence
  Description of Artificial Sequence: Synthetic polypeptide
CEEEISCTNPVATEQYGQCVCQMWGEDHNAENFNSDTQP

SEQ ID NO: 208679 - protein, 39 aa, Artificial Sequence
  Description of Artificial Sequence: Synthetic polypeptide
DDAEISTTNPVATEGYGQCVCSNWGEDHNAEYFNSEFQF

SEQ ID NO: 208680 - protein, 39 aa, Artificial Sequence
  Description of Artificial Sequence: Synthetic polypeptide
DQACISTTNPVATEQYGQCSCSNWGEDHNAEHFGSDTQA

SEQ ID NO: 208681 - protein, 39 aa, Artificial Sequence
  Description of Artificial Sequence: Synthetic polypeptide
DDAEISTTNPVATEGYGQCVCSNWGEDHNAENFNSDTQA

SEQ ID NO: 208682 - protein, 39 aa, Artificial Sequence
  Description of Artificial Sequence: Synthetic polypeptide
CEEEISTTNPCAYEQYGQCVCSDWEEDHNAEYFNSDNQS

SEQ ID NO: 208683 - protein, 39 aa, Artificial Sequence
  Description of Artificial Sequence: Synthetic polypeptide
DDAEISTTNPVATEGYGQCVCSNWGEDHNAENFGSDFQS

SEQ ID NO: 208684 - protein, 42 aa, Artificial Sequence
  Description of Artificial Sequence: Synthetic polypeptide
DPEEEVITRGTNPVATWEWYHGENVNSTDEQEVVIMNNLPAV

SEQ ID NO: 208685 - protein, 38 aa, Artificial Sequence
  Description of Artificial Sequence: Synthetic polypeptide
SEEEARCATTNPVAYEPWGSVAIANHDEATGPIEHQDN

SEQ ID NO: 208686 - protein, 40 aa, Artificial Sequence
  Description of Artificial Sequence: Synthetic polypeptide
DEEEISTTNPVAYEQYGQCQVCSNWGEDHNQENFISETQS

SEQ ID NO: 208687 - protein, 40 aa, Artificial Sequence
  Description of Artificial Sequence: Synthetic polypeptide
DEEEISTTNPVAYEQYGQCQVCSNWGEDHNAENFISDTQS

SEQ ID NO: 208688 - protein, 38 aa, Artificial Sequence
  Description of Artificial Sequence: Synthetic polypeptide
CEEEISCTNPVAYEGYGCVCSNWGEDHNAENFNSDTQA

SEQ ID NO: 208689 - protein, 39 aa, Artificial Sequence
  Description of Artificial Sequence: Synthetic polypeptide
DDAEISTTNPVATEGYGQCVCSNWGEDHNAENFNSDTQQ

SEQ ID NO: 208690 - protein, 37 aa, Artificial Sequence
  Description of Artificial Sequence: Synthetic polypeptide
QENEIATTNPTAYEQWGATYYSIEIEEMNQREMDMYR

SEQ ID NO: 208691 - protein, 40 aa, Artificial Sequence
  Description of Artificial Sequence: Synthetic polypeptide
AEEEISTTNPVAYEQYGQCQVCSNWGEDHNTEYFNSDTQA

SEQ ID NO: 208692 - protein, 38 aa, Artificial Sequence
  Description of Artificial Sequence: Synthetic polypeptide
DDAEISTTNPVAYEGYGCVCGNWGEDPNIEGFNSDNQS

SEQ ID NO: 208693 - protein, 39 aa, Artificial Sequence
  Description of Artificial Sequence: Synthetic polypeptide
DEACISTTNPVATEQYGQCVCQNWGPDHNAENFNSETQA

SEQ ID NO: 208694 - protein, 39 aa, Artificial Sequence
  Description of Artificial Sequence: Synthetic polypeptide
DEACISTTNPVATEQYGQCVCQNWGEDHNAENFNSQTQS

SEQ ID NO: 208695 - protein, 39 aa, Artificial Sequence
  Description of Artificial Sequence: Synthetic polypeptide
DEACISTTNPVATEQYGQCVCGNWGEDHNIENFMSDTQS

SEQ ID NO: 208696 - protein, 39 aa, Artificial Sequence
  Description of Artificial Sequence: Synthetic polypeptide
DEACISTTNPVATEQYGQCVCGNWGEDHNAENFNSDFQA

SEQ ID NO: 208697 - protein, 39 aa, Artificial Sequence
  Description of Artificial Sequence: Synthetic polypeptide
DEACISTTNPVATEQYGQCVCGNWGEDHDAESFNSDNQS

SEQ ID NO: 208698 - protein, 38 aa, Artificial Sequence
  Description of Artificial Sequence: Synthetic polypeptide
DEACISTTNPVATEQYGQCVCEWGEDPNAEYFISDTQS

SEQ ID NO: 208699 - protein, 39 aa, Artificial Sequence
  Description of Artificial Sequence: Synthetic polypeptide
DEEAISTTNPVATCGYGQCVCSNWGEDHNAENFNSETQA

SEQ ID NO: 208700 - protein, 39 aa, Artificial Sequence
  Description of Artificial Sequence: Synthetic polypeptide
DDEEISTTNPVATEGWGQCVCSNWGEDHNAEGFNSDTQA

SEQ ID NO: 208701 - protein, 39 aa, Artificial Sequence
  Description of Artificial Sequence: Synthetic polypeptide
DDEEISTTNPVATEEYGQCVCSNWGEDHNAENFISDTQA

SEQ ID NO: 208702 - protein, 39 aa, Artificial Sequence
  Description of Artificial Sequence: Synthetic polypeptide
DEEAISTTNPVATEGYGQCVCGNWEEDHNAENFISDFQS

SEQ ID NO: 208703 - protein, 40 aa, Artificial Sequence
  Description of Artificial Sequence: Synthetic polypeptide
DEACISTTNPVATEQYGQCQVCSNWGEDHNAENFNSDTQG

SEQ ID NO: 208704 - protein, 39 aa, Artificial Sequence
  Description of Artificial Sequence: Synthetic polypeptide
DEEAISCTNPVATEGYGQCVCSNWGEDHNAENFNSDTQS

SEQ ID NO: 208705 - protein, 37 aa, Artificial Sequence
  Description of Artificial Sequence: Synthetic polypeptide
DEEEIATTNPVCYDQYGCTIPNPNVVPAEASINEQTS

SEQ ID NO: 208706 - protein, 39 aa, Artificial Sequence
  Description of Artificial Sequence: Synthetic polypeptide
DDAEISTTNPVAYEGYGQCVCSTWGEDHNAENFNSDNQG

SEQ ID NO: 208707 - protein, 40 aa, Artificial Sequence
  Description of Artificial Sequence: Synthetic polypeptide
DEACISTTNPVATEQYGQCQVCSNWGEDHNAENFNSDNQA

SEQ ID NO: 208708 - protein, 39 aa, Artificial Sequence
  Description of Artificial Sequence: Synthetic polypeptide
DDECIRTTNPVAYEGYGQCVCSNWGEDHNAEHFNSENQL

SEQ ID NO: 208709 - protein, 39 aa, Artificial Sequence
  Description of Artificial Sequence: Synthetic polypeptide
DDECIRTTNPVAYEGYGQCVCSNWGEDHNAEHFNSENQS

SEQ ID NO: 208710 - protein, 39 aa, Artificial Sequence
  Description of Artificial Sequence: Synthetic polypeptide
DDECIRTTNPVAYEGYGQCVCSNWGEDHNAENFNSDTQS

SEQ ID NO: 208711 - protein, 40 aa, Artificial Sequence
  Description of Artificial Sequence: Synthetic polypeptide
DEACISTTNPVATEQYGQCQVCSNWGEDDNTENFNSDTQS

SEQ ID NO: 208712 - protein, 39 aa, Artificial Sequence
  Description of Artificial Sequence: Synthetic polypeptide
DDECISCTNPVATEQYGQCVCSNWGEDHNAENFNSQTQS

SEQ ID NO: 208713 - protein, 39 aa, Artificial Sequence
  Description of Artificial Sequence: Synthetic polypeptide
DEEAISCTNPVAYEQYGQCVCSNWGEDHNAEYFNSDTQS

SEQ ID NO: 208714 - protein, 40 aa, Artificial Sequence
  Description of Artificial Sequence: Synthetic polypeptide
DEACISTTNPVATEQYGQCQVCSNSGEDHNAENFNSDNQA

SEQ ID NO: 208715 - protein, 39 aa, Artificial Sequence
  Description of Artificial Sequence: Synthetic polypeptide
DDEEISTTNPVATEGWGQCVCSNWGEDHNAESFNSDTQS

SEQ ID NO: 208716 - protein, 40 aa, Artificial Sequence
  Description of Artificial Sequence: Synthetic polypeptide
DDEEISTTNPVATEGYGQCQVCSNWGEDHNAEGFNSDTQQ

SEQ ID NO: 208717 - protein, 38 aa, Artificial Sequence
  Description of Artificial Sequence: Synthetic polypeptide
EEAAIATTNPVAAEAYGSVCSHSNCIAGHSGGHSIFDG

SEQ ID NO: 208718 - protein, 39 aa, Artificial Sequence
  Description of Artificial Sequence: Synthetic polypeptide
DDEEISTTNPVATEGYGQCVCSNWGEDHNAENFPSDTQS

SEQ ID NO: 208719 - protein, 37 aa, Artificial Sequence
  Description of Artificial Sequence: Synthetic polypeptide
EEAAIATTNPVATGAYGSVCSWSCIAGHSGGHSIFDG

SEQ ID NO: 208720 - protein, 35 aa, Artificial Sequence
  Description of Artificial Sequence: Synthetic polypeptide
EEAAIGCTNPVATEQYGCLCTATDGWPVEFETIKQ

SEQ ID NO: 208721 - protein, 38 aa, Artificial Sequence
  Description of Artificial Sequence: Synthetic polypeptide
DDMEISTTNPVAYEGYGCVCSNWEEDHNAENFNSDNQG

SEQ ID NO: 208722 - protein, 39 aa, Artificial Sequence
  Description of Artificial Sequence: Synthetic polypeptide
DDEEISTTNPVATEGYGQCVCSNWGEDHNAENFISETQD

SEQ ID NO: 208723 - protein, 39 aa, Artificial Sequence
  Description of Artificial Sequence: Synthetic polypeptide
DDEEISTTNPVATEGYGQCVCSNWGEDHNAENFISDTQS

SEQ ID NO: 208724 - protein, 39 aa, Artificial Sequence
  Description of Artificial Sequence: Synthetic polypeptide
DDEEISTTNPVATEGYGQCVCSNWGEDHNAENFISDTQA

SEQ ID NO: 208725 - protein, 39 aa, Artificial Sequence
  Description of Artificial Sequence: Synthetic polypeptide
DDMEISTTNPVAYEGYGQCVCSNWGELHNTENFSSENQS

SEQ ID NO: 208726 - protein, 39 aa, Artificial Sequence
  Description of Artificial Sequence: Synthetic polypeptide
DDNCISTTNPVATEQYGQCVCSNWGEAHNAENFNSDTQS

SEQ ID NO: 208727 - protein, 38 aa, Artificial Sequence
  Description of Artificial Sequence: Synthetic polypeptide
DDMEISTTNPVAYEQYGCVCSNWGEDPNAEFFISDTQA

SEQ ID NO: 208728 - protein, 39 aa, Artificial Sequence
  Description of Artificial Sequence: Synthetic polypeptide
DEEEIATTNPVAYGEPPWGHPAATAANNNMQDSPMGSDN

SEQ ID NO: 208729 - protein, 38 aa, Artificial Sequence
  Description of Artificial Sequence: Synthetic polypeptide
DDMEISTTNPVAYEQYGQCVCQNWGAHNIENFMSDTQS

SEQ ID NO: 208730 - protein, 39 aa, Artificial Sequence
  Description of Artificial Sequence: Synthetic polypeptide
DDMEISTTNPVAYEQYGQCVCSNSGEDHNAEHFNSDNQS

SEQ ID NO: 208731 - protein, 39 aa, Artificial Sequence
  Description of Artificial Sequence: Synthetic polypeptide
DDMEISTTNPVAYEQYGQCVCSNWEEDHNIENFNSDPQA

SEQ ID NO: 208732 - protein, 39 aa, Artificial Sequence
  Description of Artificial Sequence: Synthetic polypeptide
DDMEISTTNPVAYEQYGQCVCSNWGEDHNAEHFNSDTQS

SEQ ID NO: 208733 - protein, 39 aa, Artificial Sequence
  Description of Artificial Sequence: Synthetic polypeptide
DDEEISTTNPVATEGYGQCVCSNWEEDHNAENFISDTQS

SEQ ID NO: 208734 - protein, 39 aa, Artificial Sequence
  Description of Artificial Sequence: Synthetic polypeptide
DDMEIVTTNPVAYEQYGQCVCSNWGEDPNAEFFNSDTQA

SEQ ID NO: 208735 - protein, 39 aa, Artificial Sequence
  Description of Artificial Sequence: Synthetic polypeptide
DDEEISTTNPVATEGYGQCVCSMWGEDHNQENFISQTQS

SEQ ID NO: 208736 - protein, 39 aa, Artificial Sequence
  Description of Artificial Sequence: Synthetic polypeptide
DDEEISTTNPVATEGYGQCVCGDWGEDHNAEHFNSDNQS

SEQ ID NO: 208737 - protein, 39 aa, Artificial Sequence
  Description of Artificial Sequence: Synthetic polypeptide
DDMEISTTNPVAYEQYGQCQVCGNSGEDNTENFNSETQS

SEQ ID NO: 208738 - protein, 38 aa, Artificial Sequence
  Description of Artificial Sequence: Synthetic polypeptide
DDECISCTNPVATEQYGQCVCSNWGEDNAENFISDTQS

SEQ ID NO: 208739 - protein, 39 aa, Artificial Sequence
  Description of Artificial Sequence: Synthetic polypeptide
DDECISTTNPVATEGYGQCIVCSNWMEHNTENFNSETQS

SEQ ID NO: 208740 - protein, 39 aa, Artificial Sequence
  Description of Artificial Sequence: Synthetic polypeptide
DDECISTTNPVATEGYGQCVCSMWGEEHNAENFNSDTQA

SEQ ID NO: 208741 - protein, 39 aa, Artificial Sequence
  Description of Artificial Sequence: Synthetic polypeptide
DEACISTTNPVATEGYGQCVCSNWGEDHNAESFISENQS

SEQ ID NO: 208742 - protein, 39 aa, Artificial Sequence
  Description of Artificial Sequence: Synthetic polypeptide
DEACISTTNPVATEGYGQCVCSNWGEDHNAENFNSDTQS

SEQ ID NO: 208743 - protein, 39 aa, Artificial Sequence
  Description of Artificial Sequence: Synthetic polypeptide
DEACISTTNPVATEGYGQCVCSNWGEDDNAENFNSDNQS

SEQ ID NO: 208744 - protein, 39 aa, Artificial Sequence
  Description of Artificial Sequence: Synthetic polypeptide
AEEEISTTNPVAYEQYGQCVCSNWGEDHNAENFISDTQP

SEQ ID NO: 208745 - protein, 39 aa, Artificial Sequence
  Description of Artificial Sequence: Synthetic polypeptide
DEACISTTNPVATEGYGQCVCSNWEPDHNAENFNSDFQA

SEQ ID NO: 208746 - protein, 39 aa, Artificial Sequence
  Description of Artificial Sequence: Synthetic polypeptide
AEEEISTTNPVAYEQYGQCVCSNWGEDHNAENFISDTQG

SEQ ID NO: 208747 - protein, 39 aa, Artificial Sequence
  Description of Artificial Sequence: Synthetic polypeptide
DEACISTTNPVATEGYGQCVCSNWEEDHNAENFISDNQS

SEQ ID NO: 208748 - protein, 39 aa, Artificial Sequence
  Description of Artificial Sequence: Synthetic polypeptide
DEACISTTNPVATEGYGQCVCSDWEEDHNAENFNSDTQS

SEQ ID NO: 208749 - protein, 39 aa, Artificial Sequence
  Description of Artificial Sequence: Synthetic polypeptide
AEEEISTTNPVAYEQYGQCVCSNWEEDHNAENFTSDTQS

SEQ ID NO: 208750 - protein, 39 aa, Artificial Sequence
  Description of Artificial Sequence: Synthetic polypeptide
DEACISTTNPVATEGYGQCVCSNWGEDHNAEYFNSETQS

SEQ ID NO: 208751 - protein, 39 aa, Artificial Sequence
  Description of Artificial Sequence: Synthetic polypeptide
AEEEISTTNPVAYEQYGQCVCSNSGEDHNAENFISDTQS

SEQ ID NO: 208752 - protein, 39 aa, Artificial Sequence
  Description of Artificial Sequence: Synthetic polypeptide
DEACISTTNPVATEGYGQCVCGNSGEDHNAENFISDNQA

SEQ ID NO: 208753 - protein, 39 aa, Artificial Sequence
  Description of Artificial Sequence: Synthetic polypeptide
DEACISTTNPVATEGYGQCVCGNSGEAHNAENFNSDTQS

SEQ ID NO: 208754 - protein, 38 aa, Artificial Sequence
  Description of Artificial Sequence: Synthetic polypeptide
DEACISTTNPVATEGYGQCVCENWGEPNAEYFGSDTQA

SEQ ID NO: 208755 - protein, 37 aa, Artificial Sequence
  Description of Artificial Sequence: Synthetic polypeptide
DSAEVASTNPVSYEPYGNVVAANATISQMSTGGGNRL

SEQ ID NO: 208756 - protein, 39 aa, Artificial Sequence
  Description of Artificial Sequence: Synthetic polypeptide
AEEEISTTNPVAYEQYGQCVCGNWGEDPNAENFNSDNQA

SEQ ID NO: 208757 - protein, 39 aa, Artificial Sequence
  Description of Artificial Sequence: Synthetic polypeptide
AEEEISTTNPVAYEQYGQCVCGNWGEDDNAENFNSDTQN

SEQ ID NO: 208758 - protein, 39 aa, Artificial Sequence
  Description of Artificial Sequence: Synthetic polypeptide
DEACISTTNPVATEGYGQCQVCQNSGEHNTENFISETQA

SEQ ID NO: 208759 - protein, 39 aa, Artificial Sequence
  Description of Artificial Sequence: Synthetic polypeptide
AEEEISTTNPVAYEQYGQCVCGNWGEDDNAENFNSDTQG

SEQ ID NO: 208760 - protein, 39 aa, Artificial Sequence
  Description of Artificial Sequence: Synthetic polypeptide
AEEEISTTNPVAYEQYGQCQVCYNWGEHNTENFNSETQL

SEQ ID NO: 208761 - protein, 39 aa, Artificial Sequence
  Description of Artificial Sequence: Synthetic polypeptide
DDECISTTNPVATEHYGQCVCSMWGEDHNAEHFNSQNQS

SEQ ID NO: 208762 - protein, 39 aa, Artificial Sequence
  Description of Artificial Sequence: Synthetic polypeptide
AEEEISTTNPVAYEQYGQCVCSNWGEDHNAENFISDTQS

SEQ ID NO: 208763 - protein, 39 aa, Artificial Sequence
  Description of Artificial Sequence: Synthetic polypeptide
DSECIRTTNPVGTEQWGQCVCSNWGEDDNAENFNSVTQS

SEQ ID NO: 208764 - protein, 37 aa, Artificial Sequence
  Description of Artificial Sequence: Synthetic polypeptide
QENEIATTNPVATAQWGCNVAGEHGWEEMNAALDNHD

SEQ ID NO: 208765 - protein, 39 aa, Artificial Sequence
  Description of Artificial Sequence: Synthetic polypeptide
DDECISTTNPVATEGYGQCVCSNWGEDDNAENFNSDTQS

SEQ ID NO: 208766 - protein, 39 aa, Artificial Sequence
  Description of Artificial Sequence: Synthetic polypeptide
DDECISTTNPVATEGYGQCVCSNWGEDHNAEHFNSETQS

SEQ ID NO: 208767 - protein, 39 aa, Artificial Sequence
  Description of Artificial Sequence: Synthetic polypeptide
DDEEISTTNPCAYEQYGQCVCSNWGEDHNQENFNSDTQA

SEQ ID NO: 208768 - protein, 39 aa, Artificial Sequence
  Description of Artificial Sequence: Synthetic polypeptide
DDECISTTNPVATEGYGQCVCSNWGEDHNAENFISQNQS

SEQ ID NO: 208769 - protein, 39 aa, Artificial Sequence
  Description of Artificial Sequence: Synthetic polypeptide
DDEEISCTNPVAYEQYGQCVCSNWGEDHNAEYFGSETQS

SEQ ID NO: 208770 - protein, 39 aa, Artificial Sequence
  Description of Artificial Sequence: Synthetic polypeptide
DDEEISCTNPVAYEQYGQCVCSNSGEDDNAENFNSDFQM

SEQ ID NO: 208771 - protein, 39 aa, Artificial Sequence
  Description of Artificial Sequence: Synthetic polypeptide
DDAEISTTNPVAYEGYGQCVCSNSGEDHNAENFGSDNQA

SEQ ID NO: 208772 - protein, 39 aa, Artificial Sequence
  Description of Artificial Sequence: Synthetic polypeptide
DDECISTTNPVATEGYGQCVCSNWGEDHNAESFNSDNQS

SEQ ID NO: 208773 - protein, 39 aa, Artificial Sequence
  Description of Artificial Sequence: Synthetic polypeptide
DDECISTTNPVATEGYGQCVCSNWGEDPNAENFNSDNQA

SEQ ID NO: 208774 - protein, 40 aa, Artificial Sequence
  Description of Artificial Sequence: Synthetic polypeptide
AEEEISTVNPVATEQYGQCQVCSNWEEDHNAENFNSDTQV

SEQ ID NO: 208775 - protein, 39 aa, Artificial Sequence
  Description of Artificial Sequence: Synthetic polypeptide
DDNEISTTNPVAYEQYGQCVCSNSGEDPNAENFISDNQA

SEQ ID NO: 208776 - protein, 39 aa, Artificial Sequence
  Description of Artificial Sequence: Synthetic polypeptide
DDNEISTTNPVAYEQYGQCVCSNWGEDHNAEHFNSDNQS

SEQ ID NO: 208777 - protein, 39 aa, Artificial Sequence
  Description of Artificial Sequence: Synthetic polypeptide
AEEEISTTNPVAYEQYGQCVCYNWGEDHNAENFNSDTQS

SEQ ID NO: 208778 - protein, 39 aa, Artificial Sequence
  Description of Artificial Sequence: Synthetic polypeptide
DEACISTTNPVATEQWGQCVCGNSGEDHNAENFNSDTQS

SEQ ID NO: 208779 - protein, 39 aa, Artificial Sequence
  Description of Artificial Sequence: Synthetic polypeptide
DDEEISCTNPVATEGYGQCVCSNWGEDHNAEYFNSDTQS

SEQ ID NO: 208780 - protein, 39 aa, Artificial Sequence
  Description of Artificial Sequence: Synthetic polypeptide
DDEEISCTNPVATEGYGQCVCSNWGEDHNAENFNSETQF

SEQ ID NO: 208781 - protein, 39 aa, Artificial Sequence
  Description of Artificial Sequence: Synthetic polypeptide
DEACISTTNPVATEGYGQCVCSNWGELHNAEFFNSETQS

SEQ ID NO: 208782 - protein, 39 aa, Artificial Sequence
  Description of Artificial Sequence: Synthetic polypeptide
DDEEISCTNPCATEQYGQCVCSNWEEDHNAEGFNSDTQS

SEQ ID NO: 208783 - protein, 35 aa, Artificial Sequence
  Description of Artificial Sequence: Synthetic polypeptide
QENEIATTNPVATASWGCIAGKGKEEMNAMADNHN

SEQ ID NO: 208784 - protein, 37 aa, Artificial Sequence
  Description of Artificial Sequence: Synthetic polypeptide
QENEIATTNPVATASWGACVYAGKGVEEMNAMADNHN

SEQ ID NO: 208785 - protein, 36 aa, Artificial Sequence
  Description of Artificial Sequence: Synthetic polypeptide
QENEIATTNPVATASWGACVAGEEGEEMNAALDNSK

SEQ ID NO: 208786 - protein, 38 aa, Artificial Sequence
  Description of Artificial Sequence: Synthetic polypeptide
SEEEIATTNPVAYEPPWGTFNGGVNPVGQANQGDNSDA

SEQ ID NO: 208787 - protein, 34 aa, Artificial Sequence
  Description of Artificial Sequence: Synthetic polypeptide
TEAEIASTNPVGYEAWGVCAPTDRDQHQQQHQMR

SEQ ID NO: 208788 - protein, 37 aa, Artificial Sequence
  Description of Artificial Sequence: Synthetic polypeptide
DSSEVASTNPVSYEPYGNVVAANATISQMETVGQNRL

SEQ ID NO: 208789 - protein, 39 aa, Artificial Sequence
  Description of Artificial Sequence: Synthetic polypeptide
DEAAISTTNPVATEGYGQCVCSNWGEDHNAENFNSDFQS

SEQ ID NO: 208790 - protein, 39 aa, Artificial Sequence
  Description of Artificial Sequence: Synthetic polypeptide
CEACIGTTNPVATEQYGQCVCSNWGEDHNAENFNSETQI

SEQ ID NO: 208791 - protein, 39 aa, Artificial Sequence
  Description of Artificial Sequence: Synthetic polypeptide
DENEISTTNPVAYEGYGQCQVCSWEEDHNAENFNSEFQS

SEQ ID NO: 208792 - protein, 39 aa, Artificial Sequence
  Description of Artificial Sequence: Synthetic polypeptide
DENEISTTNPVAYEGYGQCVCGNSGEDHNAENFSSDNQA

SEQ ID NO: 208793 - protein, 40 aa, Artificial Sequence
  Description of Artificial Sequence: Synthetic polypeptide
DEECISTTNPVAYEQYGQCQVCSNWGEDDNQEYFGSDTQS

SEQ ID NO: 208794 - protein, 40 aa, Artificial Sequence
  Description of Artificial Sequence: Synthetic polypeptide
DEECISTTNPVAYEQYGQCQVCSNWGEDHNAEGFNSDTQQ

SEQ ID NO: 208795 - protein, 40 aa, Artificial Sequence
  Description of Artificial Sequence: Synthetic polypeptide
DEECISTTNPVAYEQYGQCQVCSNWGEDHNAENFISDNQS

SEQ ID NO: 208796 - protein, 39 aa, Artificial Sequence
  Description of Artificial Sequence: Synthetic polypeptide
DENEISTTNPVAYEGYGQCVCSNSGEDPNAENFNSDTQA

SEQ ID NO: 208797 - protein, 37 aa, Artificial Sequence
  Description of Artificial Sequence: Synthetic polypeptide
DETEIACTNPVATEQWGCVAAPPGGSHPEAEDHLMEN

SEQ ID NO: 208798 - protein, 35 aa, Artificial Sequence
  Description of Artificial Sequence: Synthetic polypeptide
IEAAIGTTNPVATEQFGCLCTATDGWPVEFETDKQ

SEQ ID NO: 208799 - protein, 39 aa, Artificial Sequence
  Description of Artificial Sequence: Synthetic polypeptide
DEECISTTNPVAYEQYGQCVCGNWEEDHNIENFNSDPQA

SEQ ID NO: 208800 - protein, 39 aa, Artificial Sequence
  Description of Artificial Sequence: Synthetic polypeptide
DEECISTTNPVAYEQYGQCVCGNWGEDHNAEFFNSDTQS

SEQ ID NO: 208801 - protein, 39 aa, Artificial Sequence
  Description of Artificial Sequence: Synthetic polypeptide
DEECISTTNPVAYEQYGQCVCGNWGEDHNAEHFNSQNQA

SEQ ID NO: 208802 - protein, 39 aa, Artificial Sequence
  Description of Artificial Sequence: Synthetic polypeptide
DEECISTTNPVAYEQYGQCVCGNWGEDHNAENFQSDTQS

SEQ ID NO: 208803 - protein, 39 aa, Artificial Sequence
  Description of Artificial Sequence: Synthetic polypeptide
DEECISTTNPVAYEQYGQCVCGNWGEDHNAEYFNSDTQP

SEQ ID NO: 208804 - protein, 39 aa, Artificial Sequence
  Description of Artificial Sequence: Synthetic polypeptide
DEECISTTNPVAYEQYGQCVCPNWGEDHNAENFISDNQN

SEQ ID NO: 208805 - protein, 36 aa, Artificial Sequence
  Description of Artificial Sequence: Synthetic polypeptide
DETEGIRNTNPIATECWGATTWANAEDWAEPKGPYI

SEQ ID NO: 208806 - protein, 35 aa, Artificial Sequence
  Description of Artificial Sequence: Synthetic polypeptide
DETEIACTNPIATECWGATTWANAEDWAEPKGPYI

SEQ ID NO: 208807 - protein, 37 aa, Artificial Sequence
  Description of Artificial Sequence: Synthetic polypeptide
DETEIACTNPVATEQWGCVAGPAGEPGQEHHDIFEAE

SEQ ID NO: 208808 - protein, 40 aa, Artificial Sequence
  Description of Artificial Sequence: Synthetic polypeptide
DEECISTTNPVAYEQYGQCQVCSNWEEDHNAENFNSDPQA

SEQ ID NO: 208809 - protein, 40 aa, Artificial Sequence
  Description of Artificial Sequence: Synthetic polypeptide
DENEISTTNPVAYEGYGQCAVCSNWEEDHNAENFGSENQS

SEQ ID NO: 208810 - protein, 39 aa, Artificial Sequence
  Description of Artificial Sequence: Synthetic polypeptide
DEAAIGTTNPVAYEYYGQCVCSNWPEDHNTENFNSDNAS

SEQ ID NO: 208811 - protein, 39 aa, Artificial Sequence
  Description of Artificial Sequence: Synthetic polypeptide
DEECISTTNPVAYEGYGQCVCSNWGEDHNAEYFNSETQS

SEQ ID NO: 208812 - protein, 39 aa, Artificial Sequence
  Description of Artificial Sequence: Synthetic polypeptide
DEECISTTNPVAYEGYGQCVCSNWGEGHNAENFNSDTQL

SEQ ID NO: 208813 - protein, 39 aa, Artificial Sequence
  Description of Artificial Sequence: Synthetic polypeptide
DEECISTTNPVAYEGYGQCVCSNWGEGHNIEGFNSDNQP

SEQ ID NO: 208814 - protein, 39 aa, Artificial Sequence
  Description of Artificial Sequence: Synthetic polypeptide
DEAAIGTTNPVAYEQYGQCVCSNWGEDHNAENFNSDNQS

SEQ ID NO: 208815 - protein, 38 aa, Artificial Sequence
  Description of Artificial Sequence: Synthetic polypeptide
DEECISTTNPVAYEGYGQCVCSNWGEHNEENFISDTQA

SEQ ID NO: 208816 - protein, 39 aa, Artificial Sequence
  Description of Artificial Sequence: Synthetic polypeptide
DEECISTTNPVAYEQWGQCVCQNSGEDPNAENFNSDNQA

SEQ ID NO: 208817 - protein, 37 aa, Artificial Sequence
  Description of Artificial Sequence: Synthetic polypeptide
DATAEIATTNPVAYEQWGSTCAMNNGGEPAIGGGEMW

SEQ ID NO: 208818 - protein, 40 aa, Artificial Sequence
  Description of Artificial Sequence: Synthetic polypeptide
DEEEISTTNPVATEGYGQCAVCSNWGEDHNAENFISDTQS

SEQ ID NO: 208819 - protein, 39 aa, Artificial Sequence
  Description of Artificial Sequence: Synthetic polypeptide
DENEISTTNPVAYEEYGQCVCSNWEEDDNAENFNSDNQA

SEQ ID NO: 208820 - protein, 37 aa, Artificial Sequence
  Description of Artificial Sequence: Synthetic polypeptide
DENEISTTNPVAYEGWGCVCSNSGEPNAEYSISDTAS

SEQ ID NO: 208821 - protein, 36 aa, Artificial Sequence
  Description of Artificial Sequence: Synthetic polypeptide
DEGEIAPTNPIAYEPFGVNTNAVAEDQAEGGTVPAI

SEQ ID NO: 208822 - protein, 39 aa, Artificial Sequence
  Description of Artificial Sequence: Synthetic polypeptide
DEECISTTNPVAYEQYGQCAVCGNWGEHNAESFNSDTQL

SEQ ID NO: 208823 - protein, 39 aa, Artificial Sequence
  Description of Artificial Sequence: Synthetic polypeptide
DETEIACTNPVATEQWGHVVATAGGGGIDNPTGDDQLNI

SEQ ID NO: 208824 - protein, 37 aa, Artificial Sequence
  Description of Artificial Sequence: Synthetic polypeptide
DETEIACTNPVATEQWGGCCNAANGHEQDSPDDSDEK

SEQ ID NO: 208825 - protein, 40 aa, Artificial Sequence
  Description of Artificial Sequence: Synthetic polypeptide
DEECISTTNPVAYEQYGQCAVCSNWGEDDNAEFFNSDNQS

SEQ ID NO: 208826 - protein, 40 aa, Artificial Sequence
  Description of Artificial Sequence: Synthetic polypeptide
DEECISTTNPVAYEQYGQCQVCGNSGEDHNAENFNSDTQS

SEQ ID NO: 208827 - protein, 36 aa, Artificial Sequence
  Description of Artificial Sequence: Synthetic polypeptide
DETEGIRATNPIATECWGATTWANAEDWAEGKGPYI

SEQ ID NO: 208828 - protein, 39 aa, Artificial Sequence
  Description of Artificial Sequence: Synthetic polypeptide
DEECISTTNPVAYEQYGQCVCPNWGEDHNTENFMSDTQA

SEQ ID NO: 208829 - protein, 37 aa, Artificial Sequence
  Description of Artificial Sequence: Synthetic polypeptide
TEHPIATTNPVAYEQYGVTVVCLGGEEFTMPGEQNDN

SEQ ID NO: 208830 - protein, 38 aa, Artificial Sequence
  Description of Artificial Sequence: Synthetic polypeptide
CEAAISTTNPVATEQYGQCVCSNWGEHNAENFISDTQA

SEQ ID NO: 208831 - protein, 36 aa, Artificial Sequence
  Description of Artificial Sequence: Synthetic polypeptide
QAHEIATTNPVAYEQWGHCNVFAGNGGDATANAEEF

SEQ ID NO: 208832 - protein, 39 aa, Artificial Sequence
  Description of Artificial Sequence: Synthetic polypeptide
DENEISTVNPVAYEQYGQCVCSNWGEDHNAENFNSDTQA

SEQ ID NO: 208833 - protein, 37 aa, Artificial Sequence
  Description of Artificial Sequence: Synthetic polypeptide
DAQQIATTNPVAYEQWGSICAMTAGIGIATGDDNGTP

SEQ ID NO: 208834 - protein, 39 aa, Artificial Sequence
  Description of Artificial Sequence: Synthetic polypeptide
DEECISTTNPVAYEQYGQCVCSNWGEDHNQEYFISETQS

SEQ ID NO: 208835 - protein, 37 aa, Artificial Sequence
  Description of Artificial Sequence: Synthetic polypeptide
QAHEIATTNPVATEQYGCVAAGPGPAPEAGTPMEDHW

SEQ ID NO: 208836 - protein, 39 aa, Artificial Sequence
  Description of Artificial Sequence: Synthetic polypeptide
CDEEISTTNPVAYEQYGQCVCSNWGPDHNAENFGSDTQS

SEQ ID NO: 208837 - protein, 38 aa, Artificial Sequence
  Description of Artificial Sequence: Synthetic polypeptide
DEECISTVNPVATEGYGCVCSNWGEDHNEEYFISDTQS

SEQ ID NO: 208838 - protein, 34 aa, Artificial Sequence
  Description of Artificial Sequence: Synthetic polypeptide
AESELASTNPVGTEAWGVCAPTDRDQHQGQDDIG

SEQ ID NO: 208839 - protein, 40 aa, Artificial Sequence
  Description of Artificial Sequence: Synthetic polypeptide
CDEEISTTNPVATEQYGQCQVCSNWGEDHNAEHFNSDTQM

SEQ ID NO: 208840 - protein, 38 aa, Artificial Sequence
  Description of Artificial Sequence: Synthetic polypeptide
MDEAISTTNPVATEYYGCVCSNWGEDHNAENFNSDTQS

SEQ ID NO: 208841 - protein, 37 aa, Artificial Sequence
  Description of Artificial Sequence: Synthetic polypeptide
VEDEIATTNPVAYEQWTTTFACAATAGELPDSGENGH

SEQ ID NO: 208842 - protein, 40 aa, Artificial Sequence
  Description of Artificial Sequence: Synthetic polypeptide
DENEIRCTNPVATEGYGQCAVCSNWEEDHNAENFNSENQS

SEQ ID NO: 208843 - protein, 38 aa, Artificial Sequence
  Description of Artificial Sequence: Synthetic polypeptide
MEAEIATTNPVAYEQYGQCVCSVWGEDNAEGFISDTQA

SEQ ID NO: 208844 - protein, 38 aa, Artificial Sequence
  Description of Artificial Sequence: Synthetic polypeptide
MEAEISTTNPCAYEQYGCVCSNWGEDHNAENFNSDNQS

SEQ ID NO: 208845 - protein, 37 aa, Artificial Sequence
  Description of Artificial Sequence: Synthetic polypeptide
DEEEIACTNPVAYEPVWGHSACAAANGDAMGPGDQHQ

SEQ ID NO: 208846 - protein, 39 aa, Artificial Sequence
  Description of Artificial Sequence: Synthetic polypeptide
DEEEIGTTNPVAYEGYGQCVCQNWGEDHNAENFNSDNQS

SEQ ID NO: 208847 - protein, 38 aa, Artificial Sequence
  Description of Artificial Sequence: Synthetic polypeptide
VEDEIATTNPVAYEQWGTCNVAAAAWDLPAPRTSNDSL

SEQ ID NO: 208848 - protein, 39 aa, Artificial Sequence
  Description of Artificial Sequence: Synthetic polypeptide
DENEISTTNPVSTEGYGQCICSTWEEDHNAEQFISDTQS

SEQ ID NO: 208849 - protein, 40 aa, Artificial Sequence
  Description of Artificial Sequence: Synthetic polypeptide
DENEISTTNPVATEQYGQCQVCSNSGEDHNAENFISDTQS

SEQ ID NO: 208850 - protein, 38 aa, Artificial Sequence
  Description of Artificial Sequence: Synthetic polypeptide
DENEISTTNPVSTEGYGQCICSNWEEDNAENFISDNQS

SEQ ID NO: 208851 - protein, 39 aa, Artificial Sequence
  Description of Artificial Sequence: Synthetic polypeptide
DEECISTTNPVAYEQYGQCVCSNWGEDHNAENFISDTQL

SEQ ID NO: 208852 - protein, 37 aa, Artificial Sequence
  Description of Artificial Sequence: Synthetic polypeptide
TEHPIATTNPVAYEQYGVTVVCLGGEPFTDPGEQNHN

SEQ ID NO: 208853 - protein, 37 aa, Artificial Sequence
  Description of Artificial Sequence: Synthetic polypeptide
TEHPIATTNPVAYESYGVTVVCLGGEPFTRPGEQNPN

SEQ ID NO: 208854 - protein, 36 aa, Artificial Sequence
  Description of Artificial Sequence: Synthetic polypeptide
DETDIRTTNPIATECWGATTWANAEDNWAEPKGPYI

SEQ ID NO: 208855 - protein, 39 aa, Artificial Sequence
  Description of Artificial Sequence: Synthetic polypeptide
DENEISTTNPVAYEGYGQCVCSNWEEEHNAENFISDNQE

SEQ ID NO: 208856 - protein, 39 aa, Artificial Sequence
  Description of Artificial Sequence: Synthetic polypeptide
DENEISTTNPVAYEGYGQCVCSNWGEDHNAENSNSDFQS

SEQ ID NO: 208857 - protein, 39 aa, Artificial Sequence
  Description of Artificial Sequence: Synthetic polypeptide
IEEEIRTTNPADTETQGTIGWSFVNYPTVTEVLVIQPEQ

SEQ ID NO: 208858 - protein, 37 aa, Artificial Sequence
  Description of Artificial Sequence: Synthetic polypeptide
DENEIATTNPIATECWGATTTALATDGPAEPKGSPYN

SEQ ID NO: 208859 - protein, 39 aa, Artificial Sequence
  Description of Artificial Sequence: Synthetic polypeptide
DEECISTTNPVAYEQYGQCVCQNWGEDHNAEHFNSDNQS

SEQ ID NO: 208860 - protein, 38 aa, Artificial Sequence
  Description of Artificial Sequence: Synthetic polypeptide
CEAAISCTNPVATEQYGQCVCSNWGEHNAENFISDNQQ

SEQ ID NO: 208861 - protein, 38 aa, Artificial Sequence
  Description of Artificial Sequence: Synthetic polypeptide
DENEISTTNPVAYEQWGQCVCSNSGEENAEASSSDTAA

SEQ ID NO: 208862 - protein, 37 aa, Artificial Sequence
  Description of Artificial Sequence: Synthetic polypeptide
DENEIATTNPIATECWGATYYANENDPQHEKTGKGMS

SEQ ID NO: 208863 - protein, 38 aa, Artificial Sequence
  Description of Artificial Sequence: Synthetic polypeptide
AEEEIATTNPVATEQWGGCCAAQGNPDDNTAAPGEGVH

SEQ ID NO: 208864 - protein, 39 aa, Artificial Sequence
  Description of Artificial Sequence: Synthetic polypeptide
DENEISTTNPVAYEQYGQCVCPNWGEDHNAEFFNSDNQA

SEQ ID NO: 208865 - protein, 38 aa, Artificial Sequence
  Description of Artificial Sequence: Synthetic polypeptide
DENEISTTNPVSTEGYGCICSNWEEDDNAENFNSDNQS

SEQ ID NO: 208866 - protein, 38 aa, Artificial Sequence
  Description of Artificial Sequence: Synthetic polypeptide
DAQQIATTNPVAYEQWGSICAPMTAGIGIATGGDNGRP

SEQ ID NO: 208867 - protein, 37 aa, Artificial Sequence
  Description of Artificial Sequence: Synthetic polypeptide
DEGEIATTNPTATECWGATTSANATDGPAEPKGSPYN

SEQ ID NO: 208868 - protein, 39 aa, Artificial Sequence
  Description of Artificial Sequence: Synthetic polypeptide
DEECISTTNPVAYEQYGQCVCSNWGEDHNAENFISDTQA

SEQ ID NO: 208869 - protein, 39 aa, Artificial Sequence
  Description of Artificial Sequence: Synthetic polypeptide
DENEISTTNPVSTEGYGQCICSNWEEDHNAENFGSDNQA

SEQ ID NO: 208870 - protein, 38 aa, Artificial Sequence
  Description of Artificial Sequence: Synthetic polypeptide
DEAAIRTTNGVAYCQYGCVCSNWGEDHNAEYFNSDNQS

SEQ ID NO: 208871 - protein, 37 aa, Artificial Sequence
  Description of Artificial Sequence: Synthetic polypeptide
QEEEIATTNPVAYEWYGETAPWCEHEFSHSHAEGEWA

SEQ ID NO: 208872 - protein, 39 aa, Artificial Sequence
  Description of Artificial Sequence: Synthetic polypeptide
DEEEIATTNPVAYEQWGCTNNQANMNGVDTATAQDEEWP

SEQ ID NO: 208873 - protein, 35 aa, Artificial Sequence
  Description of Artificial Sequence: Synthetic polypeptide
QENEIATTNPVAYAPWGPNTVAGEGLQNHMEMQLN

SEQ ID NO: 208874 - protein, 35 aa, Artificial Sequence
  Description of Artificial Sequence: Synthetic polypeptide
QENEIATTNPVAYAPWGNTVAGEGHPQNHMNMKKW

SEQ ID NO: 208875 - protein, 41 aa, Artificial Sequence
  Description of Artificial Sequence: Synthetic polypeptide
GEWQEEINRTTVTTNCVAATNEQYGLSEMIINQEQEQGLGI

SEQ ID NO: 208876 - protein, 39 aa, Artificial Sequence
  Description of Artificial Sequence: Synthetic polypeptide
CEAEISCTNPVATEQYGCQVCSNWGEDHNAENFNSDTQA

SEQ ID NO: 208877 - protein, 39 aa, Artificial Sequence
  Description of Artificial Sequence: Synthetic polypeptide
DEECISTTNPVAYEGYGQCVCSMWGEDHNAENFNSDTQA

SEQ ID NO: 208878 - protein, 38 aa, Artificial Sequence
  Description of Artificial Sequence: Synthetic polypeptide
DETEIATTNPIATECWGATYYANENDHQLHDKQGKGMA

SEQ ID NO: 208879 - protein, 39 aa, Artificial Sequence
  Description of Artificial Sequence: Synthetic polypeptide
DEECISTTNPVAYEGYGQCVCSMWGEPHNAENFNSDTQA

SEQ ID NO: 208880 - protein, 36 aa, Artificial Sequence
  Description of Artificial Sequence: Synthetic polypeptide
GTEAEIATTNPVAYEAWGNICATTDNQGDEDDDTHR

SEQ ID NO: 208881 - protein, 38 aa, Artificial Sequence
  Description of Artificial Sequence: Synthetic polypeptide
DETEIATTNPIATECWGATYYANENDHQHEKTGRKGAS

SEQ ID NO: 208882 - protein, 37 aa, Artificial Sequence
  Description of Artificial Sequence: Synthetic polypeptide
QEEEIATTNPVAYEWYGEHAPNCEMHEFSHSHAEGEP

SEQ ID NO: 208883 - protein, 36 aa, Artificial Sequence
  Description of Artificial Sequence: Synthetic polypeptide
GTEAEIATTNPVAYEAWGNICATTDNQGDEDDGHTH

SEQ ID NO: 208884 - protein, 37 aa, Artificial Sequence
  Description of Artificial Sequence: Synthetic polypeptide
DETEIATTNPIATECWGATTWAVATDGPAEAKGGPIN

SEQ ID NO: 208885 - protein, 36 aa, Artificial Sequence
  Description of Artificial Sequence: Synthetic polypeptide
DETEIATTNPIATECWGATTWAGATDGPANPKGPLN

SEQ ID NO: 208886 - protein, 36 aa, Artificial Sequence
  Description of Artificial Sequence: Synthetic polypeptide
DETEIATTNPIATECWGATTWAGATDGPAEPAGPYN

SEQ ID NO: 208887 - protein, 39 aa, Artificial Sequence
  Description of Artificial Sequence: Synthetic polypeptide
CEAEISCTNPVATEGYGQCVCSTSGEDHNAENFNSDTQS

SEQ ID NO: 208888 - protein, 36 aa, Artificial Sequence
  Description of Artificial Sequence: Synthetic polypeptide
GTEAEIATTNPVAYEAWGNICATTDNQGDEDQGTPH

SEQ ID NO: 208889 - protein, 36 aa, Artificial Sequence
  Description of Artificial Sequence: Synthetic polypeptide
NEMCIGTTNPVATEQYGCLCTATDGSPVEFETMDKA

SEQ ID NO: 208890 - protein, 39 aa, Artificial Sequence
  Description of Artificial Sequence: Synthetic polypeptide
DEECISTTNPVAYEGYGQCVCPNWGEDHNAEGFNSETQA

SEQ ID NO: 208891 - protein, 38 aa, Artificial Sequence
  Description of Artificial Sequence: Synthetic polypeptide
DETEIATTNPIATECWGATTTALATDGPAEPKGSPQNN

SEQ ID NO: 208892 - protein, 36 aa, Artificial Sequence
  Description of Artificial Sequence: Synthetic polypeptide
QENEIATTNPVAYAPWGTNTVAGEGHLQHQMNMKKE

SEQ ID NO: 208893 - protein, 37 aa, Artificial Sequence
  Description of Artificial Sequence: Synthetic polypeptide
DETEIATTNPIATECWGATYYANENDRQHEKDGKGMS

SEQ ID NO: 208894 - protein, 39 aa, Artificial Sequence
  Description of Artificial Sequence: Synthetic polypeptide
CEAEISTTNPVATEGYGQCVCSNWGEDHNAENFNSDFQA

SEQ ID NO: 208895 - protein, 37 aa, Artificial Sequence
  Description of Artificial Sequence: Synthetic polypeptide
DETEIATTNPIATEPWGATTWAGATDGPAEPKGPYNF

SEQ ID NO: 208896 - protein, 39 aa, Artificial Sequence
  Description of Artificial Sequence: Synthetic polypeptide
DATNEIATTNPVAYEQWGSVCAMNNGAGEPDIGGDNEQF

SEQ ID NO: 208897 - protein, 38 aa, Artificial Sequence
  Description of Artificial Sequence: Synthetic polypeptide
CEAEISTTNPVATEGYGQCVCSMWEEHNQENFMSDTQS

SEQ ID NO: 208898 - protein, 39 aa, Artificial Sequence
  Description of Artificial Sequence: Synthetic polypeptide
CEAEISTTNPVATEGYGQCQVCSNWGEHNAENFNSDTQS

SEQ ID NO: 208899 - protein, 35 aa, Artificial Sequence
  Description of Artificial Sequence: Synthetic polypeptide
QEEEIATTNPVAYEWWGEHAPWCEHEFSAHAEGEW

SEQ ID NO: 208900 - protein, 36 aa, Artificial Sequence
  Description of Artificial Sequence: Synthetic polypeptide
NEMVIGTTNPVATEQYGCLCGAWDGGPVEFETMDKQ

SEQ ID NO: 208901 - protein, 37 aa, Artificial Sequence
  Description of Artificial Sequence: Synthetic polypeptide
DETEIATTNPIATECWGVTTIANATDGPAEPKGGPYN

SEQ ID NO: 208902 - protein, 37 aa, Artificial Sequence
  Description of Artificial Sequence: Synthetic polypeptide
NEMVIGTTNPVATEQYGCCLCQATDGSPVEFGTMDKQ

SEQ ID NO: 208903 - protein, 36 aa, Artificial Sequence
  Description of Artificial Sequence: Synthetic polypeptide
DETEIATTNPIATECWGVATPWAIAADWAEPKGPYY

SEQ ID NO: 208904 - protein, 38 aa, Artificial Sequence
  Description of Artificial Sequence: Synthetic polypeptide
CEAEISTTNPVATEGWGCVCSNWGEDHNAENFNSDTQA

SEQ ID NO: 208905 - protein, 36 aa, Artificial Sequence
  Description of Artificial Sequence: Synthetic polypeptide
NEMVICTTNPVATEQYGCLCQAEDGSPVEFETMDKQ

SEQ ID NO: 208906 - protein, 38 aa, Artificial Sequence
  Description of Artificial Sequence: Synthetic polypeptide
DEGEIACTNPVATEQWGCVVAAVNVDEEAGTGTPDDSG

SEQ ID NO: 208907 - protein, 38 aa, Artificial Sequence
  Description of Artificial Sequence: Synthetic polypeptide
DEECISTTNPVAYEGYGQCVCGNWGEHNIENFNSDTQS

SEQ ID NO: 208908 - protein, 39 aa, Artificial Sequence
  Description of Artificial Sequence: Synthetic polypeptide
NEMPIGTTNPVATEQYGSCYTSPWPADLGETGLFDSPQY

SEQ ID NO: 208909 - protein, 38 aa, Artificial Sequence
  Description of Artificial Sequence: Synthetic polypeptide
CEAEISTTNPCATEGYGCVCSNWGEDHNAENFNSDTQS

SEQ ID NO: 208910 - protein, 39 aa, Artificial Sequence
  Description of Artificial Sequence: Synthetic polypeptide
CENEISTTNPVATEGYGQCVCSNWGEDHNAENFGSDTQS

SEQ ID NO: 208911 - protein, 38 aa, Artificial Sequence
  Description of Artificial Sequence: Synthetic polypeptide
DETEIATTNPIATECWGATYYANENDLQLHEKTGKGME

SEQ ID NO: 208912 - protein, 39 aa, Artificial Sequence
  Description of Artificial Sequence: Synthetic polypeptide
MEDEIRGTNPVATDAYGSVYVQDLDNNNIQQEGGEDGQG

SEQ ID NO: 208913 - protein, 38 aa, Artificial Sequence
  Description of Artificial Sequence: Synthetic polypeptide
DETEIATTNPIATECWGATTTALATDGPAEPKGNPYNH

SEQ ID NO: 208914 - protein, 36 aa, Artificial Sequence
  Description of Artificial Sequence: Synthetic polypeptide
DETEIATTNPIATECWGATTPANATDGPAEPKIPQN

SEQ ID NO: 208915 - protein, 39 aa, Artificial Sequence
  Description of Artificial Sequence: Synthetic polypeptide
DEECISTTNPVAYEGYGQCVCSNWGEDHNAENFNSDTQA

SEQ ID NO: 208916 - protein, 36 aa, Artificial Sequence
  Description of Artificial Sequence: Synthetic polypeptide
DEAEIRTTNPIATECWGATTPACAEDEWAEPTGPYI

SEQ ID NO: 208917 - protein, 39 aa, Artificial Sequence
  Description of Artificial Sequence: Synthetic polypeptide
DEECISTTNPVAYEGYGQCVCSNWGEDHNAENFNSETQM

SEQ ID NO: 208918 - protein, 39 aa, Artificial Sequence
  Description of Artificial Sequence: Synthetic polypeptide
DENAISTTNPVATEQYGQCVCSNWGEDHNQENFISDTQS

SEQ ID NO: 208919 - protein, 39 aa, Artificial Sequence
  Description of Artificial Sequence: Synthetic polypeptide
DEECISTTNPVAYEGYGQCVCSNWGEDHNAENFNSQTQS

SEQ ID NO: 208920 - protein, 38 aa, Artificial Sequence
  Description of Artificial Sequence: Synthetic polypeptide
CEACISTTNPVAYEQYGQCVCSNWEEPNTEGFNSDTQS

SEQ ID NO: 208921 - protein, 38 aa, Artificial Sequence
  Description of Artificial Sequence: Synthetic polypeptide
CEACISTTNPVAYEQYGCVCSNWGEDHNEENFNSDTQA

SEQ ID NO: 208922 - protein, 39 aa, Artificial Sequence
  Description of Artificial Sequence: Synthetic polypeptide
CEACISTTNPVATEQYGQCVCSNWGEDHNAENFGSDTQA

SEQ ID NO: 208923 - protein, 39 aa, Artificial Sequence
  Description of Artificial Sequence: Synthetic polypeptide
DENAISTTNPVATEQYGQCVCQNWGEEHNAENFNSDTQS

SEQ ID NO: 208924 - protein, 39 aa, Artificial Sequence
  Description of Artificial Sequence: Synthetic polypeptide
DEECISTTNPVAYEGYGQCVCSNWGEDHNAENSNSDTQL

SEQ ID NO: 208925 - protein, 38 aa, Artificial Sequence
  Description of Artificial Sequence: Synthetic polypeptide
DENAISTTNPVATEQWGCVCSNSGEDENAEYSISDTAS

SEQ ID NO: 208926 - protein, 39 aa, Artificial Sequence
  Description of Artificial Sequence: Synthetic polypeptide
DEECISTTNPVAYEGYGQCVCSNWGEDHNAESFNSDFQA

SEQ ID NO: 208927 - protein, 34 aa, Artificial Sequence
  Description of Artificial Sequence: Synthetic polypeptide
DETEIAPTNPIATECWGATTWAAEDWAEPKGPYI

SEQ ID NO: 208928 - protein, 39 aa, Artificial Sequence
  Description of Artificial Sequence: Synthetic polypeptide
DETEIACTNPVAYEQWGSPATPAQGGPEEPDMNLENAHA

SEQ ID NO: 208929 - protein, 39 aa, Artificial Sequence
  Description of Artificial Sequence: Synthetic polypeptide
DEECISTTNPVAYEGYGQCVCSNWGEDHNAESFNSDTQS

SEQ ID NO: 208930 - protein, 39 aa, Artificial Sequence
  Description of Artificial Sequence: Synthetic polypeptide
DEECISTTNPVAYEGYGQCVCSNWGEDHNAEYFNSEFQS

SEQ ID NO: 208931 - protein, 38 aa, Artificial Sequence
  Description of Artificial Sequence: Synthetic polypeptide
AEEEIATTNPVAYEQYGQCFCPNWGEDNAEHFSSETQS

SEQ ID NO: 208932 - protein, 39 aa, Artificial Sequence
  Description of Artificial Sequence: Synthetic polypeptide
NEEEISTTNPVATEAYGQCVCSNWGEDHNAEFFISDTQS

SEQ ID NO: 208933 - protein, 38 aa, Artificial Sequence
  Description of Artificial Sequence: Synthetic polypeptide
VEDEIACTNPVAYEQWGPCSAGTNPVGPADAGGGNDHL

SEQ ID NO: 208934 - protein, 39 aa, Artificial Sequence
  Description of Artificial Sequence: Synthetic polypeptide
DEECISTTNPVAYEGYGQCVCSNWGEDHNAENFNSDNQA

SEQ ID NO: 208935 - protein, 39 aa, Artificial Sequence
  Description of Artificial Sequence: Synthetic polypeptide
DEECISTTNPVAYEGYGQCVCSNWGEDDNAENFNSETQA

SEQ ID NO: 208936 - protein, 36 aa, Artificial Sequence
  Description of Artificial Sequence: Synthetic polypeptide
NEHEIATTNPVAYESYGEHIPWCEHEFSINAEGEWQ

SEQ ID NO: 208937 - protein, 36 aa, Artificial Sequence
  Description of Artificial Sequence: Synthetic polypeptide
GTEAEIATTNPVAYEAWGNICATTDNQGDVDDGTSH

SEQ ID NO: 208938 - protein, 36 aa, Artificial Sequence
  Description of Artificial Sequence: Synthetic polypeptide
DETEIATTNPIATECWGATTNAGATDGGAEPKGPYN

SEQ ID NO: 208939 - protein, 36 aa, Artificial Sequence
  Description of Artificial Sequence: Synthetic polypeptide
GVEAEIATTNPVAYEAWGNICATTDNQGDEDDGTEH

SEQ ID NO: 208940 - protein, 39 aa, Artificial Sequence
  Description of Artificial Sequence: Synthetic polypeptide
DEECISTTNPVAYEGYGQCVCSNWEEDHNAENFNSDTQG

SEQ ID NO: 208941 - protein, 39 aa, Artificial Sequence
  Description of Artificial Sequence: Synthetic polypeptide
DENEISTTNPVATEGYGQCAVCSNWEEHNQENFISEFQS

SEQ ID NO: 208942 - protein, 39 aa, Artificial Sequence
  Description of Artificial Sequence: Synthetic polypeptide
CEAEIRTTNPVAYEPWGCAYNQLQRPNDKDERKGDKDGR

SEQ ID NO: 208943 - protein, 37 aa, Artificial Sequence
  Description of Artificial Sequence: Synthetic polypeptide
QEEEIATTNPVAYEWYGEHAPWCEHEFSHSHPEGEWG

SEQ ID NO: 208944 - protein, 36 aa, Artificial Sequence
  Description of Artificial Sequence: Synthetic polypeptide
QENEIATTNPVAYAPWGNTVAGEGHLNQNHMNMVKV

SEQ ID NO: 208945 - protein, 34 aa, Artificial Sequence
  Description of Artificial Sequence: Synthetic polypeptide
QEQEIACTNPCSYEQWGITCYCNDQQDHGDTVET

SEQ ID NO: 208946 - protein, 39 aa, Artificial Sequence
  Description of Artificial Sequence: Synthetic polypeptide
DEECISTTNPVAYEGYGQCVCSNWEEDHNIENFNSDTQA

SEQ ID NO: 208947 - protein, 39 aa, Artificial Sequence
  Description of Artificial Sequence: Synthetic polypeptide
DEECISTTNPVAYEGYGQCVCSNWEEDHNIENSNSDPQP

SEQ ID NO: 208948 - protein, 39 aa, Artificial Sequence
  Description of Artificial Sequence: Synthetic polypeptide
DEECISTTNPVAYEGYGQCVCSNWGEDDNAEFFNSDNQS

SEQ ID NO: 208949 - protein, 35 aa, Artificial Sequence
  Description of Artificial Sequence: Synthetic polypeptide
QENEIATTNPVAYAPWGNTVAGEGHLNNHQMNMKK

SEQ ID NO: 208950 - protein, 39 aa, Artificial Sequence
  Description of Artificial Sequence: Synthetic polypeptide
DEECISTTNPVAYEGYGQCVCSNWGEDDNAENFNSDNQP

SEQ ID NO: 208951 - protein, 39 aa, Artificial Sequence
  Description of Artificial Sequence: Synthetic polypeptide
NEEEISTTNPVATEGYGQCVCSNWGEDHNDENFISDTQS

SEQ ID NO: 208952 - protein, 39 aa, Artificial Sequence
  Description of Artificial Sequence: Synthetic polypeptide
CEAEIATTNPVATEQWGHVCASAGPAPIDNMTGDDNDND

SEQ ID NO: 208953 - protein, 39 aa, Artificial Sequence
  Description of Artificial Sequence: Synthetic polypeptide
DEECISTTNPVAYEGYGQCVCSNWGEDHNAEHFNSDTQA

SEQ ID NO: 208954 - protein, 36 aa, Artificial Sequence
  Description of Artificial Sequence: Synthetic polypeptide
DETEIATTNPIATEPWGNTTTAGATDGPAEPKGPYN

SEQ ID NO: 208955 - protein, 37 aa, Artificial Sequence
  Description of Artificial Sequence: Synthetic polypeptide
VEDEIATTNPVAYEQWGSVCAADGPAWIDAGDPMESW

SEQ ID NO: 208956 - protein, 34 aa, Artificial Sequence
  Description of Artificial Sequence: Synthetic polypeptide
TESEIAATNPVGTEAWGVCAPTDRDQHQQQHQMN

SEQ ID NO: 208957 - protein, 40 aa, Artificial Sequence
  Description of Artificial Sequence: Synthetic polypeptide
MEGEIRTTNPVATEQYGTSYIREAMSWDEMTTFESVQQEG

SEQ ID NO: 208958 - protein, 40 aa, Artificial Sequence
  Description of Artificial Sequence: Synthetic polypeptide
MEGEIRTTNPVATEQYGTSYIRNAMSWDYETTRESVQQEG

SEQ ID NO: 208959 - protein, 40 aa, Artificial Sequence
  Description of Artificial Sequence: Synthetic polypeptide
DEQEIATTNPVATEQWGCTNNQANMNGVSTATAGGDEEWP

SEQ ID NO: 208960 - protein, 36 aa, Artificial Sequence
  Description of Artificial Sequence: Synthetic polypeptide
CAEEIATTNPVAYAQWGCNTAGNNGPTTAGGGNLES

SEQ ID NO: 208961 - protein, 39 aa, Artificial Sequence
  Description of Artificial Sequence: Synthetic polypeptide
CEMEISTTNPVATEGYGQCVCSNWGEDHNAEFFNSETQS

SEQ ID NO: 208962 - protein, 38 aa, Artificial Sequence
  Description of Artificial Sequence: Synthetic polypeptide
CEMEISTTNPCAYEQYGQCVCSDWEEHNAENFNSDTQS

SEQ ID NO: 208963 - protein, 37 aa, Artificial Sequence
  Description of Artificial Sequence: Synthetic polypeptide
CAEEIATTNPVAYEPQWGCVAGGATGPAEAAIGDDGE

SEQ ID NO: 208964 - protein, 40 aa, Artificial Sequence
  Description of Artificial Sequence: Synthetic polypeptide
CEMEISTTNPVATEQYGQCQVCSNWGPDHNAENFNSETQA

SEQ ID NO: 208965 - protein, 39 aa, Artificial Sequence
  Description of Artificial Sequence: Synthetic polypeptide
CEMEISCTNPVATEQYGQCVCSNWGEDDNAENFNSDNQS

SEQ ID NO: 208966 - protein, 38 aa, Artificial Sequence
  Description of Artificial Sequence: Synthetic polypeptide
CDEEISTTNPVATEGYGQCVCSNWEEHNIESFISDTQA

SEQ ID NO: 208967 - protein, 37 aa, Artificial Sequence
  Description of Artificial Sequence: Synthetic polypeptide
VEDEIACTNPVATEQWGCIAAIANADTAAATGDDNED

SEQ ID NO: 208968 - protein, 39 aa, Artificial Sequence
  Description of Artificial Sequence: Synthetic polypeptide
CDEEISCTNPVATEQYGQCVCSNWMEDHNAENFNSDNQM

SEQ ID NO: 208969 - protein, 40 aa, Artificial Sequence
  Description of Artificial Sequence: Synthetic polypeptide
MEMEEISTTNPVATEQYGSDTYCAGCMEMLAQQMAVAVHD

SEQ ID NO: 208970 - protein, 37 aa, Artificial Sequence
  Description of Artificial Sequence: Synthetic polypeptide
QAEEIATTNPVATEQYGCFAAPGPAPEAGTPMEDTPW

SEQ ID NO: 208971 - protein, 37 aa, Artificial Sequence
  Description of Artificial Sequence: Synthetic polypeptide
NEAEIATTNPVAYEAWGVVWPGPNNENDEGHQKNGEE

SEQ ID NO: 208972 - protein, 37 aa, Artificial Sequence
  Description of Artificial Sequence: Synthetic polypeptide
DENEIATTNPVAYAPPWGSTLAGNNGQHQNHQDGDMK

SEQ ID NO: 208973 - protein, 39 aa, Artificial Sequence
  Description of Artificial Sequence: Synthetic polypeptide
CDEEISTTNPVATEGYGQCVCSNWGEDDNAENFNSDFQA

SEQ ID NO: 208974 - protein, 38 aa, Artificial Sequence
  Description of Artificial Sequence: Synthetic polypeptide
DEDEIATTNPVAYQMPYGHSTPAANNGETGTQGGSTEQ

SEQ ID NO: 208975 - protein, 38 aa, Artificial Sequence
  Description of Artificial Sequence: Synthetic polypeptide
DEQEIATTNPVATEQWGCCTALAGNPGIDAPGMEGGVG

SEQ ID NO: 208976 - protein, 37 aa, Artificial Sequence
  Description of Artificial Sequence: Synthetic polypeptide
VEDEIATTNPVAYAPWGTFACAATAGELPDSAGNARY

SEQ ID NO: 208977 - protein, 39 aa, Artificial Sequence
  Description of Artificial Sequence: Synthetic polypeptide
DEAEIRTTNGVAYCQYGQCVCGNWGEDHNQEYFGSDTQS

SEQ ID NO: 208978 - protein, 39 aa, Artificial Sequence
  Description of Artificial Sequence: Synthetic polypeptide
MEEEISTTNPVAYEQYGQCVCYNWGEDHNTENFNSETQS

SEQ ID NO: 208979 - protein, 39 aa, Artificial Sequence
  Description of Artificial Sequence: Synthetic polypeptide
AEYEIRCTNPVATEQYGQCVCENWGEDHNAEHFGSDTQS

SEQ ID NO: 208980 - protein, 40 aa, Artificial Sequence
  Description of Artificial Sequence: Synthetic polypeptide
DEEEISCTNPVATEQYGQCQICSNWEEDHNIEFFNSDTQS

SEQ ID NO: 208981 - protein, 37 aa, Artificial Sequence
  Description of Artificial Sequence: Synthetic polypeptide
DEMVIGTTNPVAYEQWGCVCSWGDDDNAEYFISDTQA

SEQ ID NO: 208982 - protein, 37 aa, Artificial Sequence
  Description of Artificial Sequence: Synthetic polypeptide
DEGEIATTNPVAYAPWGHSFACAAANGLPQGSEVDDS

SEQ ID NO: 208983 - protein, 39 aa, Artificial Sequence
  Description of Artificial Sequence: Synthetic polypeptide
VEDEIATTNPVAYEPQWGPCVAINHAGLGTAHQMDNEQN

SEQ ID NO: 208984 - protein, 39 aa, Artificial Sequence
  Description of Artificial Sequence: Synthetic polypeptide
DEGEIATTNPVAYEPQWGACITAGENALTAEPPGGDFMQ

SEQ ID NO: 208985 - protein, 40 aa, Artificial Sequence
  Description of Artificial Sequence: Synthetic polypeptide
DEGEIATTNPVAYEPQWGHSVVAGAGHALDGAAPGDQTNH

SEQ ID NO: 208986 - protein, 39 aa, Artificial Sequence
  Description of Artificial Sequence: Synthetic polypeptide
DEGEIATTNPVAYEQWGHCIIFAGNDGLVDNDGGENTAM

SEQ ID NO: 208987 - protein, 38 aa, Artificial Sequence
  Description of Artificial Sequence: Synthetic polypeptide
DEGEIATTNPVAYEQWGHCIIFAGNSGLVDNDGEIEAE

SEQ ID NO: 208988 - protein, 39 aa, Artificial Sequence
  Description of Artificial Sequence: Synthetic polypeptide
DEGEIATTNPVAYEQWGHCIIFAGNSGLVDNDMGENDAG

SEQ ID NO: 208989 - protein, 39 aa, Artificial Sequence
  Description of Artificial Sequence: Synthetic polypeptide
CEMEISTTNPVAYEQYGQCVCSNSGEDPNAENFNSDTQM

SEQ ID NO: 208990 - protein, 38 aa, Artificial Sequence
  Description of Artificial Sequence: Synthetic polypeptide
DEGEIATTNPVAYEQWGHCIIFAGNSGLVDNDSENDAM

SEQ ID NO: 208991 - protein, 41 aa, Artificial Sequence
  Description of Artificial Sequence: Synthetic polypeptide
TTEEGTCEECIATVNVATEQYGAVSTVASYTELGSVGNANI

SEQ ID NO: 208992 - protein, 39 aa, Artificial Sequence
  Description of Artificial Sequence: Synthetic polypeptide
QAEEIATTNPVATEQYGNCVAPGEGGHGQNESAEEANNI

SEQ ID NO: 208993 - protein, 39 aa, Artificial Sequence
  Description of Artificial Sequence: Synthetic polypeptide
CEMEISTTNPVATEQYGQCVCGNWGEDHNAESFNSDNQL

SEQ ID NO: 208994 - protein, 38 aa, Artificial Sequence
  Description of Artificial Sequence: Synthetic polypeptide
DENEIATTNPVAYADPWGCNPTPAMNHLETQGGPMQKD

SEQ ID NO: 208995 - protein, 36 aa, Artificial Sequence
  Description of Artificial Sequence: Synthetic polypeptide
CEGEIATTNPVATASWGCCSATGAGGTAPQDIADFK

SEQ ID NO: 208996 - protein, 37 aa, Artificial Sequence
  Description of Artificial Sequence: Synthetic polypeptide
VEDEIACTNPVATEQWGCVAAIANADTAAATLDDNEM

SEQ ID NO: 208997 - protein, 36 aa, Artificial Sequence
  Description of Artificial Sequence: Synthetic polypeptide
VEDEIACTNPVATEQWGCVAGAGPAPNAHGFDESFE

SEQ ID NO: 208998 - protein, 37 aa, Artificial Sequence
  Description of Artificial Sequence: Synthetic polypeptide
VEDEIACTNPVAYEQWGTICSMAPNLGEEHQIDIQAM

SEQ ID NO: 208999 - protein, 38 aa, Artificial Sequence
  Description of Artificial Sequence: Synthetic polypeptide
CDAEISTTNPVAYEQYGCVCSNWGEDHNAENFNSDFQS

SEQ ID NO: 209000 - protein, 38 aa, Artificial Sequence
  Description of Artificial Sequence: Synthetic polypeptide
MESEIRTTNPVATEIWGECVCPDTRVPEEAMEYFGVEN

SEQ ID NO: 209001 - protein, 40 aa, Artificial Sequence
  Description of Artificial Sequence: Synthetic polypeptide
MESEIRTTNPVATEIYGECVCPDDTRVPEEQYMEGFGVEN

SEQ ID NO: 209002 - protein, 38 aa, Artificial Sequence
  Description of Artificial Sequence: Synthetic polypeptide
MESEIRTTNPVATEQWGNCCKAFYVMDQEPDEDHNQDQ

SEQ ID NO: 209003 - protein, 37 aa, Artificial Sequence
  Description of Artificial Sequence: Synthetic polypeptide
CDEAISTTNPVAYEQYGCVCSNWGEHNAENFISDFQA

SEQ ID NO: 209004 - protein, 39 aa, Artificial Sequence
  Description of Artificial Sequence: Synthetic polypeptide
MESEIRTTNPVATEQWGNCQKAFYVQDQEPNDTDHNQDQ

SEQ ID NO: 209005 - protein, 36 aa, Artificial Sequence
  Description of Artificial Sequence: Synthetic polypeptide
VEDEIACTNPVAYEQWGSVCNADGPAMIDNDPMESW

SEQ ID NO: 209006 - protein, 39 aa, Artificial Sequence
  Description of Artificial Sequence: Synthetic polypeptide
VEDEIACTNPVAYEPWGHSVSAIADGALTQTNHGDSSRE

SEQ ID NO: 209007 - protein, 35 aa, Artificial Sequence
  Description of Artificial Sequence: Synthetic polypeptide
VEDEIACTNPVAYEQWGCCAPGNPGEATAHMDGEA

SEQ ID NO: 209008 - protein, 38 aa, Artificial Sequence
  Description of Artificial Sequence: Synthetic polypeptide
MESEIRTTNPVATEQWGNCGKAAYVQDQEPDIDHNQDQ

SEQ ID NO: 209009 - protein, 35 aa, Artificial Sequence
  Description of Artificial Sequence: Synthetic polypeptide
VEDEIACTNPVAYEQWGCCATGAPGEATAHIDGEF

SEQ ID NO: 209010 - protein, 37 aa, Artificial Sequence
  Description of Artificial Sequence: Synthetic polypeptide
VEDEIACTNPVAYEQWGCNSATNGNPGEATAHGDGET

SEQ ID NO: 209011 - protein, 36 aa, Artificial Sequence
  Description of Artificial Sequence: Synthetic polypeptide
VEDEIACTNPVAYEQWGSVCADIPAWIDQGDPMEAW

SEQ ID NO: 209012 - protein, 38 aa, Artificial Sequence
  Description of Artificial Sequence: Synthetic polypeptide
MESEIRTTNPVATEQWGNCGVWAFDVMDQEPDDHLQDQ

SEQ ID NO: 209013 - protein, 36 aa, Artificial Sequence
  Description of Artificial Sequence: Synthetic polypeptide
VEDEIACTNPVAYEQWGSVCAADGPAWIDNDPMEEW

SEQ ID NO: 209014 - protein, 37 aa, Artificial Sequence
  Description of Artificial Sequence: Synthetic polypeptide
VEDEIACTNPVAYEQWGPCVAGNNGLPADAGGGGDHL

SEQ ID NO: 209015 - protein, 38 aa, Artificial Sequence
  Description of Artificial Sequence: Synthetic polypeptide
CDAEISTTNPVATEQYGQCVCSNWGEHDAENFNSDTQS

SEQ ID NO: 209016 - protein, 38 aa, Artificial Sequence
  Description of Artificial Sequence: Synthetic polypeptide
DENEIATTNPVSTEGYGCICSNWEEDDNAEYFNSDTQA

SEQ ID NO: 209017 - protein, 37 aa, Artificial Sequence
  Description of Artificial Sequence: Synthetic polypeptide
QAEEIATTNPVATASYGCVAPGEGGHGQNESAEEANY

SEQ ID NO: 209018 - protein, 38 aa, Artificial Sequence
  Description of Artificial Sequence: Synthetic polypeptide
DEEEIACTNPVATEQWGCTWIFALAGMHGPDDSGEGAQ

SEQ ID NO: 209019 - protein, 37 aa, Artificial Sequence
  Description of Artificial Sequence: Synthetic polypeptide
VEDEIACTNPVATEQWGCVAGNPGPHEPDAGGDGGDY

SEQ ID NO: 209020 - protein, 39 aa, Artificial Sequence
  Description of Artificial Sequence: Synthetic polypeptide
CEGEIATTNPVATEQWGHVVVANSGHALENGMPMEDIEN

SEQ ID NO: 209021 - protein, 35 aa, Artificial Sequence
  Description of Artificial Sequence: Synthetic polypeptide
NEAEIASTNPVAYEQWGEVVCGVAQLDHVDTSTDA

SEQ ID NO: 209022 - protein, 37 aa, Artificial Sequence
  Description of Artificial Sequence: Synthetic polypeptide
VEDEIACTNPVATEQYGCNPANNPAVGQAHQDDMEAE

SEQ ID NO: 209023 - protein, 39 aa, Artificial Sequence
  Description of Artificial Sequence: Synthetic polypeptide
CDECISTTNPVATEQYGQCVCSNWGEDHNAENFNSDFQS

SEQ ID NO: 209024 - protein, 39 aa, Artificial Sequence
  Description of Artificial Sequence: Synthetic polypeptide
CDECISTTNPVATEQYGQCVCSNWGEDHNAEHFNSDTQS

SEQ ID NO: 209025 - protein, 41 aa, Artificial Sequence
  Description of Artificial Sequence: Synthetic polypeptide
NVMEEEICIGTVNCTTNVATEQYGSVTVEETINTEYGSQTR

SEQ ID NO: 209026 - protein, 38 aa, Artificial Sequence
  Description of Artificial Sequence: Synthetic polypeptide
CDAAISTTNPVATEQYGQCVCSNWGEHNAEHFNSDTQM

SEQ ID NO: 209027 - protein, 39 aa, Artificial Sequence
  Description of Artificial Sequence: Synthetic polypeptide
NDECIRTTNPVATEGYGQCVCSNWGEDHNDEFFNSDTQS

SEQ ID NO: 209028 - protein, 37 aa, Artificial Sequence
  Description of Artificial Sequence: Synthetic polypeptide
MEQEIATTNPVAYEQWGCNVAGSGFDEAGMPLEDAAE

SEQ ID NO: 209029 - protein, 37 aa, Artificial Sequence
  Description of Artificial Sequence: Synthetic polypeptide
MEQEIATTNPVAYEQWGHCHAASGGFTEAGMPLENDA

SEQ ID NO: 209030 - protein, 39 aa, Artificial Sequence
  Description of Artificial Sequence: Synthetic polypeptide
DEEEIACTNPVATEQWGNTTTAKTGMILTAPDDLMDNHM

SEQ ID NO: 209031 - protein, 38 aa, Artificial Sequence
  Description of Artificial Sequence: Synthetic polypeptide
DEEEIACTNPVATEQWGCTVIFAGAGMHAGPDDSGEGA

SEQ ID NO: 209032 - protein, 38 aa, Artificial Sequence
  Description of Artificial Sequence: Synthetic polypeptide
CDAEISTTNPVATEGYGQCVCSNWEEHNQESFNSDTQA

SEQ ID NO: 209033 - protein, 38 aa, Artificial Sequence
  Description of Artificial Sequence: Synthetic polypeptide
CDECISCTNPVATEQYGQCVCSNWGEHNAEHFNSDTQM

SEQ ID NO: 209034 - protein, 39 aa, Artificial Sequence
  Description of Artificial Sequence: Synthetic polypeptide
CDAEISTTNPVATEGYGQCVCSTWGEDHNAEYFISDNQS

SEQ ID NO: 209035 - protein, 38 aa, Artificial Sequence
  Description of Artificial Sequence: Synthetic polypeptide
DEEEIACTNPVATEQWGCTVIVAGAGMPHGPDDSGEGA

SEQ ID NO: 209036 - protein, 39 aa, Artificial Sequence
  Description of Artificial Sequence: Synthetic polypeptide
CDAEISTTNPVATEQYGQCVCSNWGEAHNAENFGSDFQS

SEQ ID NO: 209037 - protein, 38 aa, Artificial Sequence
  Description of Artificial Sequence: Synthetic polypeptide
DEAEIRTTNPCATEGWGCQSCGNAEEDNAENSISDNQA

SEQ ID NO: 209038 - protein, 39 aa, Artificial Sequence
  Description of Artificial Sequence: Synthetic polypeptide
DEMEIRTTNPVATEGWGQCVCSNWGEDENQEYFISDTQA

SEQ ID NO: 209039 - protein, 39 aa, Artificial Sequence
  Description of Artificial Sequence: Synthetic polypeptide
DEEEISCTNPVAYEGYGQCVCSNWGEDHNAENFISENQA

SEQ ID NO: 209040 - protein, 36 aa, Artificial Sequence
  Description of Artificial Sequence: Synthetic polypeptide
VEDEIATTNPVAYEPWGSFTPAANNGETGTEGGSEA

SEQ ID NO: 209041 - protein, 39 aa, Artificial Sequence
  Description of Artificial Sequence: Synthetic polypeptide
DEEEISTTNPCAYEGYGQCVCSNWGEDPNEENFNSDTQA

SEQ ID NO: 209042 - protein, 37 aa, Artificial Sequence
  Description of Artificial Sequence: Synthetic polypeptide
QAEEIATTNPVAYEQWGSICAMNNGAGEPDIGGDEMW

SEQ ID NO: 209043 - protein, 36 aa, Artificial Sequence
  Description of Artificial Sequence: Synthetic polypeptide
DENSIATTNPTAYEQWGATYYNIEIEMNQREMDHHI

SEQ ID NO: 209044 - protein, 39 aa, Artificial Sequence
  Description of Artificial Sequence: Synthetic polypeptide
DENEIATTNPVATEQWGCTNNSANMNGVDTATAADEEKP

SEQ ID NO: 209045 - protein, 38 aa, Artificial Sequence
  Description of Artificial Sequence: Synthetic polypeptide
DEEEIATTNPVAYAGWGGCTIFAGNNGDTTANQGGDAQ

SEQ ID NO: 209046 - protein, 38 aa, Artificial Sequence
  Description of Artificial Sequence: Synthetic polypeptide
VEDEIATTNPVAYEPWGHSVSAIADGALTQTNHKDSSD

SEQ ID NO: 209047 - protein, 38 aa, Artificial Sequence
  Description of Artificial Sequence: Synthetic polypeptide
QAEEIATTNPVAYEQWGQNVCAMNNGGEPDIGGNMEMW

SEQ ID NO: 209048 - protein, 38 aa, Artificial Sequence
  Description of Artificial Sequence: Synthetic polypeptide
QAEEIATTNPVAYEQWGHCIFAGNNGDVQTANAEAGEH

SEQ ID NO: 209049 - protein, 33 aa, Artificial Sequence
  Description of Artificial Sequence: Synthetic polypeptide
DDSEVASTNPIATEGWGATTAAATIQSPKGQYI

SEQ ID NO: 209050 - protein, 37 aa, Artificial Sequence
  Description of Artificial Sequence: Synthetic polypeptide
QAEEIATTNPVAYEQWGAVCAMNNGGEPDIGGDTEMW

SEQ ID NO: 209051 - protein, 39 aa, Artificial Sequence
  Description of Artificial Sequence: Synthetic polypeptide
VEDEIATTNPVAYEPWGHSVSAIADGALTQTNHGDSVDI

SEQ ID NO: 209052 - protein, 36 aa, Artificial Sequence
  Description of Artificial Sequence: Synthetic polypeptide
TESEITTTNPVAYGPYGQSVACWSAPSMSAVTSHEE

SEQ ID NO: 209053 - protein, 39 aa, Artificial Sequence
  Description of Artificial Sequence: Synthetic polypeptide
VEDEIATTNPVAYEPWGHSVSAIADGALTQTNHGDSSVH

SEQ ID NO: 209054 - protein, 39 aa, Artificial Sequence
  Description of Artificial Sequence: Synthetic polypeptide
VEDEIATTNPVAYEPWGHSVSAIADGALTQTNHGDDSDT

SEQ ID NO: 209055 - protein, 38 aa, Artificial Sequence
  Description of Artificial Sequence: Synthetic polypeptide
NEEEIATTNPVAYEQWGGCTIAGNGEHAQMNDHSGTLS

SEQ ID NO: 209056 - protein, 38 aa, Artificial Sequence
  Description of Artificial Sequence: Synthetic polypeptide
QAEEIATTNPVAYEPWGHSFVSAGAGEGNGATGPGEST

SEQ ID NO: 209057 - protein, 37 aa, Artificial Sequence
  Description of Artificial Sequence: Synthetic polypeptide
DEEEIATTNPVAYAPWNPSACAAANGDAMQATNDQHQ

SEQ ID NO: 209058 - protein, 39 aa, Artificial Sequence
  Description of Artificial Sequence: Synthetic polypeptide
VEDEIATTNPVAYEPWGHSSSAIADGALTQTNHGDSSRN

SEQ ID NO: 209059 - protein, 37 aa, Artificial Sequence
  Description of Artificial Sequence: Synthetic polypeptide
QAEEIATTNPVAYEQWGSICAMNNGKGEPTIGGGEMW

SEQ ID NO: 209060 - protein, 36 aa, Artificial Sequence
  Description of Artificial Sequence: Synthetic polypeptide
TESEICTTNPVAYGPYGQSVASCWRASSMSAVTSEE

SEQ ID NO: 209061 - protein, 38 aa, Artificial Sequence
  Description of Artificial Sequence: Synthetic polypeptide
DEAEIRTTNPCAYEGWGCQTCQNSEEDNAENSGSDNQA

SEQ ID NO: 209062 - protein, 34 aa, Artificial Sequence
  Description of Artificial Sequence: Synthetic polypeptide
TESEIASTNPVGTEAWGVCAPTDRDQHQQQHEMS

SEQ ID NO: 209063 - protein, 34 aa, Artificial Sequence
  Description of Artificial Sequence: Synthetic polypeptide
TESEIASTNPVGTEAWGVCAPTDRDQHQQQHMDD

SEQ ID NO: 209064 - protein, 34 aa, Artificial Sequence
  Description of Artificial Sequence: Synthetic polypeptide
TESEIASTNPVGTEAWGVCAPTDRDQHQQQHQTA

SEQ ID NO: 209065 - protein, 36 aa, Artificial Sequence
  Description of Artificial Sequence: Synthetic polypeptide
DENMIATTNPTAYEQWGATYYNIEIEMNQREMDSHM

SEQ ID NO: 209066 - protein, 37 aa, Artificial Sequence
  Description of Artificial Sequence: Synthetic polypeptide
VEDEIATTNPVAYEQWGSPACAADNPAWIDNDPMESW

SEQ ID NO: 209067 - protein, 36 aa, Artificial Sequence
  Description of Artificial Sequence: Synthetic polypeptide
DENMIATTNPTAYEQWGATYYNIEIEMNQRERDMED

SEQ ID NO: 209068 - protein, 36 aa, Artificial Sequence
  Description of Artificial Sequence: Synthetic polypeptide
DENMIATTNPTAYEQWGATYYNIEIEMNQRMIDDHD

SEQ ID NO: 209069 - protein, 36 aa, Artificial Sequence
  Description of Artificial Sequence: Synthetic polypeptide
VEDEIATTNPVAYEQWGPCTAGNGEPSNPDSQGKMS

SEQ ID NO: 209070 - protein, 39 aa, Artificial Sequence
  Description of Artificial Sequence: Synthetic polypeptide
DEEEIGCTNPVAYEGYGQCVCSNWGEDHNAENFNSDNQS

SEQ ID NO: 209071 - protein, 37 aa, Artificial Sequence
  Description of Artificial Sequence: Synthetic polypeptide
VEDEIATTNPVAYEQWGHCVAGTGEPTGATAGGQDGQ

SEQ ID NO: 209072 - protein, 38 aa, Artificial Sequence
  Description of Artificial Sequence: Synthetic polypeptide
VEDEIATTNPVAYEQPYGSFTPAANNGETGTTGGSEEA

SEQ ID NO: 209073 - protein, 36 aa, Artificial Sequence
  Description of Artificial Sequence: Synthetic polypeptide
VEDEIATTNPVAYEPYGYFTPAANNGETGTPGGSEA

SEQ ID NO: 209074 - protein, 37 aa, Artificial Sequence
  Description of Artificial Sequence: Synthetic polypeptide
VEDEIATTNPVAYEPYGSFTPAANNGETGTDGGSDEA

SEQ ID NO: 209075 - protein, 38 aa, Artificial Sequence
  Description of Artificial Sequence: Synthetic polypeptide
MEEEIATTNPVAYEGYGCVCSVWGEGDNAEGFISDTQS

SEQ ID NO: 209076 - protein, 38 aa, Artificial Sequence
  Description of Artificial Sequence: Synthetic polypeptide
DEECLSTTNPCAYEQYGCVCSNWGEDDNQENFGSDTQS

SEQ ID NO: 209077 - protein, 37 aa, Artificial Sequence
  Description of Artificial Sequence: Synthetic polypeptide
QAEEIATTNPVAYEQWGSTCAMNNGGEADIGGDGEMW

SEQ ID NO: 209078 - protein, 37 aa, Artificial Sequence
  Description of Artificial Sequence: Synthetic polypeptide
QAEEIATTNPVAYEQWGSNCAMNNGNGEPDIGGGEMW

SEQ ID NO: 209079 - protein, 37 aa, Artificial Sequence
  Description of Artificial Sequence: Synthetic polypeptide
DENELATTNPVAYECWGIAYLGDFATANPGEKRNDMN

SEQ ID NO: 209080 - protein, 38 aa, Artificial Sequence
  Description of Artificial Sequence: Synthetic polypeptide
QAEEIATTNPVAYDPWGHSFVSAGAGEGNDGATGPNES

SEQ ID NO: 209081 - protein, 36 aa, Artificial Sequence
  Description of Artificial Sequence: Synthetic polypeptide
QAEEIATTNPVAYAQWGCNTAGNNGTTTAETGNLDS

SEQ ID NO: 209082 - protein, 38 aa, Artificial Sequence
  Description of Artificial Sequence: Synthetic polypeptide
DEAEIRTTNPCATEGWGCQTCQNWEDDNAENFGSDNQA

SEQ ID NO: 209083 - protein, 38 aa, Artificial Sequence
  Description of Artificial Sequence: Synthetic polypeptide
DEQEIACTNPVAYEQWGHCIIFAGNNGLVDNDGENEAE

SEQ ID NO: 209084 - protein, 38 aa, Artificial Sequence
  Description of Artificial Sequence: Synthetic polypeptide
AEEEIASVNPVCTEQYGCVCSNWGELHNAESFNSDNQA

SEQ ID NO: 209085 - protein, 38 aa, Artificial Sequence
  Description of Artificial Sequence: Synthetic polypeptide
DEAEIRTTNPCATEGWGCQTCGNAEEDNAENSGSDTQA

SEQ ID NO: 209086 - protein, 37 aa, Artificial Sequence
  Description of Artificial Sequence: Synthetic polypeptide
QESEIAPTNPCSYEQYGVTVSCCGHMLSGNSNGGQDR

SEQ ID NO: 209087 - protein, 39 aa, Artificial Sequence
  Description of Artificial Sequence: Synthetic polypeptide
DEAEIRTTNPCATEGWGCQTCGNAEEADNAENSGSDNQS

SEQ ID NO: 209088 - protein, 39 aa, Artificial Sequence
  Description of Artificial Sequence: Synthetic polypeptide
DEEEISCTNPVAYEQYGQCVCSNWGEDHNAENFISDFQA

SEQ ID NO: 209089 - protein, 38 aa, Artificial Sequence
  Description of Artificial Sequence: Synthetic polypeptide
DEAEIRTTNPCATEGWGCQSCQNWEEDNAENSSSDNQA

SEQ ID NO: 209090 - protein, 37 aa, Artificial Sequence
  Description of Artificial Sequence: Synthetic polypeptide
QESEIAPTNPCSYEQYGVTVSCCGHMLSQNINGGTDV

SEQ ID NO: 209091 - protein, 38 aa, Artificial Sequence
  Description of Artificial Sequence: Synthetic polypeptide
QESEIAPTNPCSYEQYGVTVSCCWNMLSQNSNSGTDEM

SEQ ID NO: 209092 - protein, 36 aa, Artificial Sequence
  Description of Artificial Sequence: Synthetic polypeptide
TSEEIAATNPVAYEAWGVCHCIIEQLRDMGQRNTGE

SEQ ID NO: 209093 - protein, 36 aa, Artificial Sequence
  Description of Artificial Sequence: Synthetic polypeptide
DENAIATTNPTAYEQWGATYYNIEIEMNQRMMDIHD

SEQ ID NO: 209094 - protein, 39 aa, Artificial Sequence
  Description of Artificial Sequence: Synthetic polypeptide
DEAEIRTTNPCATEGWGCQSCQNAEEDDNAENSGSDNQA

SEQ ID NO: 209095 - protein, 39 aa, Artificial Sequence
  Description of Artificial Sequence: Synthetic polypeptide
DEEEISCTNPVAYEGYGQCVCSNWGELHNAENFNSDTQS

SEQ ID NO: 209096 - protein, 40 aa, Artificial Sequence
  Description of Artificial Sequence: Synthetic polypeptide
VEDEIATTNPVAYEPWGHNFVSAIADGALTQTRHGDSMRA

SEQ ID NO: 209097 - protein, 32 aa, Artificial Sequence
  Description of Artificial Sequence: Synthetic polypeptide
QESEIASTNPIGTECWGATAAEDWAEPKGPYI

SEQ ID NO: 209098 - protein, 39 aa, Artificial Sequence
  Description of Artificial Sequence: Synthetic polypeptide
DEEEISCTNPVAYEGYGQCVCSNWGEDHNAENFNSDTQG

SEQ ID NO: 209099 - protein, 38 aa, Artificial Sequence
  Description of Artificial Sequence: Synthetic polypeptide
DEQEIACTNPVAYEQWGHCIIFAGNDGLFDNDLGNDAE

SEQ ID NO: 209100 - protein, 36 aa, Artificial Sequence
  Description of Artificial Sequence: Synthetic polypeptide
TETEIRTTNPIAYECWGQATTPACAESWTEPTGGYI

SEQ ID NO: 209101 - protein, 39 aa, Artificial Sequence
  Description of Artificial Sequence: Synthetic polypeptide
DEEEISTTNPCATEGYGICCCSNWGEDHNAENFGSDTQA

SEQ ID NO: 209102 - protein, 38 aa, Artificial Sequence
  Description of Artificial Sequence: Synthetic polypeptide
QESEIAPTNPCSYEQYGVTVLSCCGHMLSQNSNGGTQR

SEQ ID NO: 209103 - protein, 36 aa, Artificial Sequence
  Description of Artificial Sequence: Synthetic polypeptide
TETEIRTTNPIAYECWGQATTPACNEHWAEPTGPYT

SEQ ID NO: 209104 - protein, 36 aa, Artificial Sequence
  Description of Artificial Sequence: Synthetic polypeptide
QAEEIATTNPVAYAQWGCNTAGNNGLTTAEGGILDS

SEQ ID NO: 209105 - protein, 38 aa, Artificial Sequence
  Description of Artificial Sequence: Synthetic polypeptide
VEDEIATTNPVAYEPWGHSSSAIADGALTQGNHGDSSD

SEQ ID NO: 209106 - protein, 39 aa, Artificial Sequence
  Description of Artificial Sequence: Synthetic polypeptide
DEECTCTNNATEQYGVVATELEGIGSTVNSVTTLQNGTT

SEQ ID NO: 209107 - protein, 38 aa, Artificial Sequence
  Description of Artificial Sequence: Synthetic polypeptide
DENEIGTTNPVATEGWGCVCSNSGPDENAENFSSDTAS

SEQ ID NO: 209108 - protein, 38 aa, Artificial Sequence
  Description of Artificial Sequence: Synthetic polypeptide
DESEISTTNPVATCHYGQCVCSNWGEHNQEYFTSDTQA

SEQ ID NO: 209109 - protein, 38 aa, Artificial Sequence
  Description of Artificial Sequence: Synthetic polypeptide
QAEEIATTNPVATESYGCVAPPGEGGHGQNESAEEANN

SEQ ID NO: 209110 - protein, 38 aa, Artificial Sequence
  Description of Artificial Sequence: Synthetic polypeptide
NEEEIATTNPVAYEQWGGCTFNAGNGEHAQMNDHHGLS

SEQ ID NO: 209111 - protein, 38 aa, Artificial Sequence
  Description of Artificial Sequence: Synthetic polypeptide
NEEEIATTNPVAYEQWGGCTFAGNGEHAQMNDHSGVTS

SEQ ID NO: 209112 - protein, 38 aa, Artificial Sequence
  Description of Artificial Sequence: Synthetic polypeptide
CEEVIACTNPVAYEQYGSPCAAAGPALGINHQMGMQMN

SEQ ID NO: 209113 - protein, 39 aa, Artificial Sequence
  Description of Artificial Sequence: Synthetic polypeptide
VEDEIATTNPVAYEPWGHSISAIADGALTQTRHGDSVDL

SEQ ID NO: 209114 - protein, 39 aa, Artificial Sequence
  Description of Artificial Sequence: Synthetic polypeptide
VEDEIATTNPVAYEPWGHSISAIADGALTQTRHGDSSVP

SEQ ID NO: 209115 - protein, 35 aa, Artificial Sequence
  Description of Artificial Sequence: Synthetic polypeptide
QEGEIASTNPCSYEQWGITCYCNDQQDQSGQTINA

SEQ ID NO: 209116 - protein, 34 aa, Artificial Sequence
  Description of Artificial Sequence: Synthetic polypeptide
QEGEIASTNPCSYEQWGITCYCNDQQDQSGQGIS

SEQ ID NO: 209117 - protein, 37 aa, Artificial Sequence
  Description of Artificial Sequence: Synthetic polypeptide
CEGEIACTNPVATEQWGTCFVANGELADIPNSDESAM

SEQ ID NO: 209118 - protein, 39 aa, Artificial Sequence
  Description of Artificial Sequence: Synthetic polypeptide
VEDEIATTNPVAYEPWGHSISAIADGALTPTRHGDSMRG

SEQ ID NO: 209119 - protein, 40 aa, Artificial Sequence
  Description of Artificial Sequence: Synthetic polypeptide
VEDEIATTNPVAYEPWGHSFVSAIADGADTNTRHGDSSRG

SEQ ID NO: 209120 - protein, 38 aa, Artificial Sequence
  Description of Artificial Sequence: Synthetic polypeptide
AEEEIASVNPVCTEQYGQCVCSNWGEDNAESFNSDNQA

SEQ ID NO: 209121 - protein, 39 aa, Artificial Sequence
  Description of Artificial Sequence: Synthetic polypeptide
CEAEISTTNPVATEGYGQCVCSNWGEDHNAENFNSDTQD

SEQ ID NO: 209122 - protein, 37 aa, Artificial Sequence
  Description of Artificial Sequence: Synthetic polypeptide
VEDEIACTNPVAYEQWGHCVAGTGEPTEATAGGQNGQ

SEQ ID NO: 209123 - protein, 36 aa, Artificial Sequence
  Description of Artificial Sequence: Synthetic polypeptide
NEMVIGTTNPVATEQYGCLCQATDGSDVFFETMDKQ

SEQ ID NO: 209124 - protein, 37 aa, Artificial Sequence
  Description of Artificial Sequence: Synthetic polypeptide
QESEIRGTNPVATEAYGAVPGDVADIGGEGGDEEDGA

SEQ ID NO: 209125 - protein, 35 aa, Artificial Sequence
  Description of Artificial Sequence: Synthetic polypeptide
DENEIACTNPIATECWGATTWANAEDWAEPKGPYI

SEQ ID NO: 209126 - protein, 38 aa, Artificial Sequence
  Description of Artificial Sequence: Synthetic polypeptide
DENEIRTTNPVSYEGYGCICSNWEEDHNAENFSSDNQA

SEQ ID NO: 209127 - protein, 38 aa, Artificial Sequence
  Description of Artificial Sequence: Synthetic polypeptide
DEDEIATTNPVAYEQWGSIICPAVADAGGDHQGDLAEM

SEQ ID NO: 209128 - protein, 37 aa, Artificial Sequence
  Description of Artificial Sequence: Synthetic polypeptide
QESEIRGTNPVATEAYGAVPGVIADIMGEGGDIEDGA

SEQ ID NO: 209129 - protein, 39 aa, Artificial Sequence
  Description of Artificial Sequence: Synthetic polypeptide
AEECISTTNPVAYEQYGQCVCSNWGEDHNAEHFNSDTQS

SEQ ID NO: 209130 - protein, 36 aa, Artificial Sequence
  Description of Artificial Sequence: Synthetic polypeptide
AESEIACTNPVGTEGYGVICQSGEHNQEHFGSDTQS

SEQ ID NO: 209131 - protein, 39 aa, Artificial Sequence
  Description of Artificial Sequence: Synthetic polypeptide
DEECISTTNPVAYEAYGQCVCSNWGEDHNAENFNSDTQG

SEQ ID NO: 209132 - protein, 36 aa, Artificial Sequence
  Description of Artificial Sequence: Synthetic polypeptide
DDSEVASTNPVSTEGYGCVCQNWGEINQEGFGSQQM

SEQ ID NO: 209133 - protein, 37 aa, Artificial Sequence
  Description of Artificial Sequence: Synthetic polypeptide
DETEIRTTNPIATECWGATTWANAEDCWVAEPKGPYI

SEQ ID NO: 209134 - protein, 39 aa, Artificial Sequence
  Description of Artificial Sequence: Synthetic polypeptide
AEECISTTNPVAYEQYGQCVCSNWGEDHNAEGFNSDTQA

SEQ ID NO: 209135 - protein, 39 aa, Artificial Sequence
  Description of Artificial Sequence: Synthetic polypeptide
DEECISTTNPVAYEAYGQCVCSNSGEDHNAENFNSDTQS

SEQ ID NO: 209136 - protein, 38 aa, Artificial Sequence
  Description of Artificial Sequence: Synthetic polypeptide
DEDEIATTNPVAYEQWGNIICPAVADAGQDHQMDNAEN

SEQ ID NO: 209137 - protein, 38 aa, Artificial Sequence
  Description of Artificial Sequence: Synthetic polypeptide
DENEIRTTNPVSYEGYGICICSNWEEHNAENFISDNQA

SEQ ID NO: 209138 - protein, 37 aa, Artificial Sequence
  Description of Artificial Sequence: Synthetic polypeptide
DETEIRTTNPIATECWGATTWANAEAWPNEPKGMPYI

SEQ ID NO: 209139 - protein, 39 aa, Artificial Sequence
  Description of Artificial Sequence: Synthetic polypeptide
AEECISTTNPVAYEQYGQCVCSNWGEDDNAENFNSETQM

SEQ ID NO: 209140 - protein, 39 aa, Artificial Sequence
  Description of Artificial Sequence: Synthetic polypeptide
AEECISTTNPVAYEQYGQCVCSNWGEDDNAENFNSDTQS

SEQ ID NO: 209141 - protein, 39 aa, Artificial Sequence
  Description of Artificial Sequence: Synthetic polypeptide
AEECISTTNPVAYEQYGQCVCSNWGEDDNAENFNSDTQA

SEQ ID NO: 209142 - protein, 39 aa, Artificial Sequence
  Description of Artificial Sequence: Synthetic polypeptide
AEECISTTNPVAYEQYGQCVCSNWGEDDNAENFNSDNQS

SEQ ID NO: 209143 - protein, 35 aa, Artificial Sequence
  Description of Artificial Sequence: Synthetic polypeptide
DETEIRTTNPIATECWGATTWAKAEDWAEPKMPYI

SEQ ID NO: 209144 - protein, 36 aa, Artificial Sequence
  Description of Artificial Sequence: Synthetic polypeptide
DETEIRTTNPIATECWGATTWAGAEDHWAEPKGPYI

SEQ ID NO: 209145 - protein, 37 aa, Artificial Sequence
  Description of Artificial Sequence: Synthetic polypeptide
AESEIACTNPVGTEGYGICSCGSGEHNAEHFNSDTQS

SEQ ID NO: 209146 - protein, 36 aa, Artificial Sequence
  Description of Artificial Sequence: Synthetic polypeptide
DETEIRTTNPIATECWGATTWAEAEDWYAEPKGPYI

SEQ ID NO: 209147 - protein, 36 aa, Artificial Sequence
  Description of Artificial Sequence: Synthetic polypeptide
DETEIRTTNPIATECWGATTWAEAEDWIAEPKGPYI

SEQ ID NO: 209148 - protein, 34 aa, Artificial Sequence
  Description of Artificial Sequence: Synthetic polypeptide
NESEIASTNPVGTEAWGVCAPTDRDQHQQQHQDG

SEQ ID NO: 209149 - protein, 36 aa, Artificial Sequence
  Description of Artificial Sequence: Synthetic polypeptide
DETEIRTTNPIATECWGATTWAEAEDWAEPKGPYIL

SEQ ID NO: 209150 - protein, 38 aa, Artificial Sequence
  Description of Artificial Sequence: Synthetic polypeptide
DETEIATTNPVAYAPEPWGPIIATANNNDTPDNQNGFD

SEQ ID NO: 209151 - protein, 36 aa, Artificial Sequence
  Description of Artificial Sequence: Synthetic polypeptide
DETEIRTTNPIATECWGATTWAAAEDWAEPKGCPYI

SEQ ID NO: 209152 - protein, 36 aa, Artificial Sequence
  Description of Artificial Sequence: Synthetic polypeptide
DETEIRTTNPIATECWGATTWAMAEDWFAEPKGPYI

SEQ ID NO: 209153 - protein, 36 aa, Artificial Sequence
  Description of Artificial Sequence: Synthetic polypeptide
DDSEVASTNPVSTEGYGCVCQNSEEINQEGFGSQQS

SEQ ID NO: 209154 - protein, 37 aa, Artificial Sequence
  Description of Artificial Sequence: Synthetic polypeptide
CEDEIACTNPVAYEQYGSCAAAGGNHGNAEGGDGMQN

SEQ ID NO: 209155 - protein, 39 aa, Artificial Sequence
  Description of Artificial Sequence: Synthetic polypeptide
DENEIRTTNPVSYEGYGQCICSNWEEDDNAEQFISDNQS

SEQ ID NO: 209156 - protein, 36 aa, Artificial Sequence
  Description of Artificial Sequence: Synthetic polypeptide
DDSEVASTNPVSTEGYGCVCGNWGEHQEYFNSQTQA

SEQ ID NO: 209157 - protein, 39 aa, Artificial Sequence
  Description of Artificial Sequence: Synthetic polypeptide
AEECISTTNPVAYEQYGQCVCSNWGEDHNAESFNSDTQA

SEQ ID NO: 209158 - protein, 39 aa, Artificial Sequence
  Description of Artificial Sequence: Synthetic polypeptide
AEECISTTNPVAYEQYGQCVCSNWGEDHNAENFNSETQP

SEQ ID NO: 209159 - protein, 39 aa, Artificial Sequence
  Description of Artificial Sequence: Synthetic polypeptide
AEECISTTNPVAYEQYGQCVCSNWGEDHNAENFNSDTQA

SEQ ID NO: 209160 - protein, 39 aa, Artificial Sequence
  Description of Artificial Sequence: Synthetic polypeptide
DEECISTTNPVAYEEYGQCVCSNWGEDHNAENFNSDTQL

SEQ ID NO: 209161 - protein, 38 aa, Artificial Sequence
  Description of Artificial Sequence: Synthetic polypeptide
DEEEIATTNPVAYEQWGHCIFAGAEAGPQAAAAGAGMN

SEQ ID NO: 209162 - protein, 38 aa, Artificial Sequence
  Description of Artificial Sequence: Synthetic polypeptide
CEPEIACTNPVAYEQWGHCNFVATGELADIGNSDESAM

SEQ ID NO: 209163 - protein, 36 aa, Artificial Sequence
  Description of Artificial Sequence: Synthetic polypeptide
QEEEIATTNPVAYESYGEHAPWCEHEFSIAAEGEAQ

SEQ ID NO: 209164 - protein, 39 aa, Artificial Sequence
  Description of Artificial Sequence: Synthetic polypeptide
DEECISTTNPVAYEEYGQCVCSNWGEDHNAENFNSDPQS

SEQ ID NO: 209165 - protein, 35 aa, Artificial Sequence
  Description of Artificial Sequence: Synthetic polypeptide
NENMIATTNPTAYEQWGATYYNIEIEMNQREMDHI

SEQ ID NO: 209166 - protein, 39 aa, Artificial Sequence
  Description of Artificial Sequence: Synthetic polypeptide
DENEISCTNPVAYEEYGQCVCSNWEEEHNAENFQSDNQA

SEQ ID NO: 209167 - protein, 36 aa, Artificial Sequence
  Description of Artificial Sequence: Synthetic polypeptide
DETEIRTTNPIATECWGATTWANAEDKMAEPKSDYI

SEQ ID NO: 209168 - protein, 37 aa, Artificial Sequence
  Description of Artificial Sequence: Synthetic polypeptide
DETEIRTTNPIATECWGATTWANAEDHWAEPKGPYIP

SEQ ID NO: 209169 - protein, 39 aa, Artificial Sequence
  Description of Artificial Sequence: Synthetic polypeptide
AEECISTTNPVAYEQYGQCVCSNWGEDHNAENFISDNQS

SEQ ID NO: 209170 - protein, 38 aa, Artificial Sequence
  Description of Artificial Sequence: Synthetic polypeptide
DENEISCTNPVATEQWGCVCSNSGEDDNAEYSISDTAS

SEQ ID NO: 209171 - protein, 37 aa, Artificial Sequence
  Description of Artificial Sequence: Synthetic polypeptide
DETEIRTTNPIATECWGATTWANAEDGWAEPKGHPYI

SEQ ID NO: 209172 - protein, 36 aa, Artificial Sequence
  Description of Artificial Sequence: Synthetic polypeptide
DETEIRTTNPIATECWGATTPACAEDHSAEETGPYI

SEQ ID NO: 209173 - protein, 36 aa, Artificial Sequence
  Description of Artificial Sequence: Synthetic polypeptide
DETEIRTTNPIATECWGATTWANAEDFWAEPKKPYI

SEQ ID NO: 209174 - protein, 37 aa, Artificial Sequence
  Description of Artificial Sequence: Synthetic polypeptide
DETEIRTTNPIATECWGATTWANAEDFWAEPKGKPYI

SEQ ID NO: 209175 - protein, 37 aa, Artificial Sequence
  Description of Artificial Sequence: Synthetic polypeptide
DETEIRTTNPIATECWGATTWANAEDFWAEPKGGPYI

SEQ ID NO: 209176 - protein, 36 aa, Artificial Sequence
  Description of Artificial Sequence: Synthetic polypeptide
QENEIATTNPVAYEPWGPNVAGEGGLQNHPMEMQLN

SEQ ID NO: 209177 - protein, 37 aa, Artificial Sequence
  Description of Artificial Sequence: Synthetic polypeptide
CEDEIACTNPVAYEQWGHCFVATGEHADIGNSDEWAM

SEQ ID NO: 209178 - protein, 39 aa, Artificial Sequence
  Description of Artificial Sequence: Synthetic polypeptide
AEECISTTNPVAYEQYGQCVCSNWGEDHNAEHFNSQTQL

SEQ ID NO: 209179 - protein, 40 aa, Artificial Sequence
  Description of Artificial Sequence: Synthetic polypeptide
FEETIRTTNPCATDQVYVIRVESLDPTVEQQFLTGMVVRF

SEQ ID NO: 209180 - protein, 40 aa, Artificial Sequence
  Description of Artificial Sequence: Synthetic polypeptide
AEEEIRTTNPVAYEGYGQCAVCSNWGEDHNAENFNSDTQS

SEQ ID NO: 209181 - protein, 36 aa, Artificial Sequence
  Description of Artificial Sequence: Synthetic polypeptide
QENEIATTNPVAYEPWGPNVAGEGLQQNHPMEMQAN

SEQ ID NO: 209182 - protein, 38 aa, Artificial Sequence
  Description of Artificial Sequence: Synthetic polypeptide
DEGSNLATTNPVAYEQWGCCTVQSCGPETSSGDGGNLM

SEQ ID NO: 209183 - protein, 38 aa, Artificial Sequence
  Description of Artificial Sequence: Synthetic polypeptide
FEENIRGTTNPVATCAFSDYVVVSVLAYVERVGELVEG

SEQ ID NO: 209184 - protein, 37 aa, Artificial Sequence
  Description of Artificial Sequence: Synthetic polypeptide
DDSEVASTNPVSTEGYGCVCGTWGEDNQEHFGSQNQA

SEQ ID NO: 209185 - protein, 38 aa, Artificial Sequence
  Description of Artificial Sequence: Synthetic polypeptide
AEEEISTTNPCATEEYGQCVCGNWGEHNAENFGSDTAA

SEQ ID NO: 209186 - protein, 36 aa, Artificial Sequence
  Description of Artificial Sequence: Synthetic polypeptide
CEPEIACTNPVAYEQWGCIAGEGPALGQNHMINQAE

SEQ ID NO: 209187 - protein, 39 aa, Artificial Sequence
  Description of Artificial Sequence: Synthetic polypeptide
QEGEIATTNPVATEQYGNISFSAPPDTLREPHEIYEDTW

SEQ ID NO: 209188 - protein, 35 aa, Artificial Sequence
  Description of Artificial Sequence: Synthetic polypeptide
DEGVACCTNPVAYAPWGSACSAAPATENDHQGTEM

SEQ ID NO: 209189 - protein, 37 aa, Artificial Sequence
  Description of Artificial Sequence: Synthetic polypeptide
DETEIRTTNPCATEGWGCQTCQNAEEDAENSGSETIA

SEQ ID NO: 209190 - protein, 39 aa, Artificial Sequence
  Description of Artificial Sequence: Synthetic polypeptide
AEEEISCTNPVAYEQYGCAVCSNWGEDHNQENFNSDTQA

SEQ ID NO: 209191 - protein, 39 aa, Artificial Sequence
  Description of Artificial Sequence: Synthetic polypeptide
AEEEISCTNPVATEGYGQCVCSNWGEPHNAENFNSETQA

SEQ ID NO: 209192 - protein, 39 aa, Artificial Sequence
  Description of Artificial Sequence: Synthetic polypeptide
AEECISTTNPVAYEGYGQCVCSNWGEGTNAENFNSDTQS

SEQ ID NO: 209193 - protein, 38 aa, Artificial Sequence
  Description of Artificial Sequence: Synthetic polypeptide
AEECISTTNPVAYEGYGQCVCSNWGEHNAENFNSDTQS

SEQ ID NO: 209194 - protein, 39 aa, Artificial Sequence
  Description of Artificial Sequence: Synthetic polypeptide
DETEIRTTNPCATEGWGQCQTCQNWEEDNAENFGSDNQA

SEQ ID NO: 209195 - protein, 36 aa, Artificial Sequence
  Description of Artificial Sequence: Synthetic polypeptide
DETEIRTTNPIATDCWGATTWANAEDAWAEPKGQYI

SEQ ID NO: 209196 - protein, 36 aa, Artificial Sequence
  Description of Artificial Sequence: Synthetic polypeptide
DETEIRTTNPIATEAWGATTPACAEGEWHEPTGPYI

SEQ ID NO: 209197 - protein, 37 aa, Artificial Sequence
  Description of Artificial Sequence: Synthetic polypeptide
DETEIRTTNPIATEAWGATTPANAEDAHAEPTGGPYI

SEQ ID NO: 209198 - protein, 39 aa, Artificial Sequence
  Description of Artificial Sequence: Synthetic polypeptide
AEEEISCTNPVATEQYGQCVCGNWGEDHNAENFNSDTQM

SEQ ID NO: 209199 - protein, 39 aa, Artificial Sequence
  Description of Artificial Sequence: Synthetic polypeptide
DENCISTTNPVATEQYGQCVCQNWEEDHNAEYFNSDTQS

SEQ ID NO: 209200 - protein, 38 aa, Artificial Sequence
  Description of Artificial Sequence: Synthetic polypeptide
AEEEISCTNPVAYEGYGQCVCSNWGEHNAENFNSETQF

SEQ ID NO: 209201 - protein, 37 aa, Artificial Sequence
  Description of Artificial Sequence: Synthetic polypeptide
DETEIRTTNPIATEAWGIATTPACAEDEVAEPTGPYI

SEQ ID NO: 209202 - protein, 39 aa, Artificial Sequence
  Description of Artificial Sequence: Synthetic polypeptide
AEEEISCTNPVAYEQYGQCVCGNSGEDHNAENFNSDTQS

SEQ ID NO: 209203 - protein, 39 aa, Artificial Sequence
  Description of Artificial Sequence: Synthetic polypeptide
DENCISTTNPVAYCQYGQCVCSNWEEDTNAENFNSQNQA

SEQ ID NO: 209204 - protein, 36 aa, Artificial Sequence
  Description of Artificial Sequence: Synthetic polypeptide
DETEIRTTNPIATEAWGTTTPACAEDEWAEPTGPYI

SEQ ID NO: 209205 - protein, 39 aa, Artificial Sequence
  Description of Artificial Sequence: Synthetic polypeptide
DEDEIATTNPVAYEQWGHCIVAGTPGGWPQAAMEGGHLK

SEQ ID NO: 209206 - protein, 37 aa, Artificial Sequence
  Description of Artificial Sequence: Synthetic polypeptide
DETEIRTTNPIATECWGAMTWANAEDFSAEPKGPYIK

SEQ ID NO: 209207 - protein, 39 aa, Artificial Sequence
  Description of Artificial Sequence: Synthetic polypeptide
AEEEISCTNPVATEQYGQCVCSNWGEDHNAENFFSETQA

SEQ ID NO: 209208 - protein, 36 aa, Artificial Sequence
  Description of Artificial Sequence: Synthetic polypeptide
DETEIRTTNPIATECWGATTAACAEDHSAEPTGPYE

SEQ ID NO: 209209 - protein, 39 aa, Artificial Sequence
  Description of Artificial Sequence: Synthetic polypeptide
AEECISTTNPVAYEQYGCAVCSNWGEDHNAENFNSDTQA

SEQ ID NO: 209210 - protein, 39 aa, Artificial Sequence
  Description of Artificial Sequence: Synthetic polypeptide
DENCISTTNPVATEQYGQCVCQNWGEDDNAENFNSDTQS

SEQ ID NO: 209211 - protein, 36 aa, Artificial Sequence
  Description of Artificial Sequence: Synthetic polypeptide
DETEIRTTNPIATECWGATTAAIAEDWAEPKGPYIH

SEQ ID NO: 209212 - protein, 37 aa, Artificial Sequence
  Description of Artificial Sequence: Synthetic polypeptide
DEDEIATTNPVAYEQWGHCIIFAGNSGLNDNSSEEDA

SEQ ID NO: 209213 - protein, 37 aa, Artificial Sequence
  Description of Artificial Sequence: Synthetic polypeptide
DETEIRTTNPIATECWGATTPACATDETAEPTGGPYI

SEQ ID NO: 209214 - protein, 37 aa, Artificial Sequence
  Description of Artificial Sequence: Synthetic polypeptide
DETEIRTTNPIATECWGATTPACAEDEVSAEPTGPYI

SEQ ID NO: 209215 - protein, 37 aa, Artificial Sequence
  Description of Artificial Sequence: Synthetic polypeptide
DEDEIATTNPVAYEQWGHCIIFAGNDGPVDNDLNDAE

SEQ ID NO: 209216 - protein, 37 aa, Artificial Sequence
  Description of Artificial Sequence: Synthetic polypeptide
DEDEIATTNPVAYEQWGHCIIFAGNDGLVDNDSEEGA

SEQ ID NO: 209217 - protein, 38 aa, Artificial Sequence
  Description of Artificial Sequence: Synthetic polypeptide
AEECISTTNPVAYEQYGCVCQNWGEDHNAENFNSEPQL

SEQ ID NO: 209218 - protein, 39 aa, Artificial Sequence
  Description of Artificial Sequence: Synthetic polypeptide
DETEIRTTNPCATEGWGCQTCGNWEEDDNAENSGSDNQA

SEQ ID NO: 209219 - protein, 39 aa, Artificial Sequence
  Description of Artificial Sequence: Synthetic polypeptide
AEEEISCTNPVATEGYGQCVCSNWGEDHNAENFNSDTQS

SEQ ID NO: 209220 - protein, 39 aa, Artificial Sequence
  Description of Artificial Sequence: Synthetic polypeptide
DENCISTTNPVAYEQYGQCVCQNSGEEHNAENFNSDTQS

SEQ ID NO: 209221 - protein, 39 aa, Artificial Sequence
  Description of Artificial Sequence: Synthetic polypeptide
DENCISTTNPVSTEGYGQCICSNWEEDDNAEQFGSDNQS

SEQ ID NO: 209222 - protein, 39 aa, Artificial Sequence
  Description of Artificial Sequence: Synthetic polypeptide
DENEISTTNPVATEGWGQCVTSNSMEDHNAENFNSDTAA

SEQ ID NO: 209223 - protein, 38 aa, Artificial Sequence
  Description of Artificial Sequence: Synthetic polypeptide
QEEEIATTNPVAYEPPWGHPAASAANGNMQDSPMGSFV

SEQ ID NO: 209224 - protein, 39 aa, Artificial Sequence
  Description of Artificial Sequence: Synthetic polypeptide
AEEEISTTNPCATEAYGQCVCSNWGEDHNAENFNSDTQS

SEQ ID NO: 209225 - protein, 38 aa, Artificial Sequence
  Description of Artificial Sequence: Synthetic polypeptide
DETEIATTNPVAYQMPYGHSTTPAANNGETGTQGGSEE

SEQ ID NO: 209226 - protein, 37 aa, Artificial Sequence
  Description of Artificial Sequence: Synthetic polypeptide
QEEEIATTNPVAYEAYGEHAPWCEHEFSQSHVEGEWI

SEQ ID NO: 209227 - protein, 39 aa, Artificial Sequence
  Description of Artificial Sequence: Synthetic polypeptide
DENCISTTNPVATEGYGQCVCSNWGEDHNAEHFNSDTQS

SEQ ID NO: 209228 - protein, 38 aa, Artificial Sequence
  Description of Artificial Sequence: Synthetic polypeptide
DEDEIATTNPVAYEQWGNIICPAVADAGQDHQDDNFEK

SEQ ID NO: 209229 - protein, 36 aa, Artificial Sequence
  Description of Artificial Sequence: Synthetic polypeptide
DETEIGTTNPIATECWGATFWANAEDWAEPKGPYIY

SEQ ID NO: 209230 - protein, 36 aa, Artificial Sequence
  Description of Artificial Sequence: Synthetic polypeptide
DETEIGTTNPIATECWGATTWANAEDEWAEPKGPYI

SEQ ID NO: 209231 - protein, 35 aa, Artificial Sequence
  Description of Artificial Sequence: Synthetic polypeptide
DETEIGTTNPIATECWGATTWANAEDWAEPKMPYI

SEQ ID NO: 209232 - protein, 36 aa, Artificial Sequence
  Description of Artificial Sequence: Synthetic polypeptide
DETEIKTTNPIATECWGATTWANAEDWAEPKGPYIQ

SEQ ID NO: 209233 - protein, 38 aa, Artificial Sequence
  Description of Artificial Sequence: Synthetic polypeptide
AEECISTTNPVAYEQYGQCVCGNWGEHNAENFNSETQP

SEQ ID NO: 209234 - protein, 36 aa, Artificial Sequence
  Description of Artificial Sequence: Synthetic polypeptide
DETEIKTTNPIATECWGATTWANAIDWAEPKGPPYI

SEQ ID NO: 209235 - protein, 36 aa, Artificial Sequence
  Description of Artificial Sequence: Synthetic polypeptide
QEEEIATTNPVAYAPWGHSFACAAANGLAISEVDDS

SEQ ID NO: 209236 - protein, 36 aa, Artificial Sequence
  Description of Artificial Sequence: Synthetic polypeptide
DETEIRTTNPIATECWGATTPAPAEDWEEPKGPYGN

SEQ ID NO: 209237 - protein, 36 aa, Artificial Sequence
  Description of Artificial Sequence: Synthetic polypeptide
QEEEIATTNPVAYAPQWGPCACAAANGDAMQGDQHL

SEQ ID NO: 209238 - protein, 39 aa, Artificial Sequence
  Description of Artificial Sequence: Synthetic polypeptide
DENCISTTNPVAYEQYGQCVCSNWGEDPNAENFNSDTQS

SEQ ID NO: 209239 - protein, 36 aa, Artificial Sequence
  Description of Artificial Sequence: Synthetic polypeptide
DETEIRATNPIATECWGATTWANAEDFWAEPKGPYI

SEQ ID NO: 209240 - protein, 39 aa, Artificial Sequence
  Description of Artificial Sequence: Synthetic polypeptide
AEECISTTNPVAYEQYGQCVCGNSGEDHNAENFGSDTQS

SEQ ID NO: 209241 - protein, 40 aa, Artificial Sequence
  Description of Artificial Sequence: Synthetic polypeptide
DENCISTTNPVATEQYGQCQVCSNWGEEHNAENFNSDTQS

SEQ ID NO: 209242 - protein, 39 aa, Artificial Sequence
  Description of Artificial Sequence: Synthetic polypeptide
AEECISTTNPVAYEQYGQCSCSNWGEDHNAENFNSDPQA

SEQ ID NO: 209243 - protein, 36 aa, Artificial Sequence
  Description of Artificial Sequence: Synthetic polypeptide
DETEIRCTNPIATECWGATTWANAEDWAEPKGQPYI

SEQ ID NO: 209244 - protein, 39 aa, Artificial Sequence
  Description of Artificial Sequence: Synthetic polypeptide
AEEEISCTNPVAYEQYGQCVCSDWGEDHNAENFNSETQG

SEQ ID NO: 209245 - protein, 39 aa, Artificial Sequence
  Description of Artificial Sequence: Synthetic polypeptide
DENCISTTNPVATEQYGQCVCGNWGEEHNAENFNSETQS

SEQ ID NO: 209246 - protein, 35 aa, Artificial Sequence
  Description of Artificial Sequence: Synthetic polypeptide
DETEIRCTNPIATECWGATTWANAEDWAEPKYPYI

SEQ ID NO: 209247 - protein, 39 aa, Artificial Sequence
  Description of Artificial Sequence: Synthetic polypeptide
DENCISTTNPVAYEQYGQCVCSNWGEDDNAENFNSDTQS

SEQ ID NO: 209248 - protein, 39 aa, Artificial Sequence
  Description of Artificial Sequence: Synthetic polypeptide
AEEEISCTNPVATEGYGQCVCSMWGEDHNAENFNSDTQP

SEQ ID NO: 209249 - protein, 35 aa, Artificial Sequence
  Description of Artificial Sequence: Synthetic polypeptide
DETEIRQTNPIATECWGATTWAEAEDWAEPKGPYI

SEQ ID NO: 209250 - protein, 36 aa, Artificial Sequence
  Description of Artificial Sequence: Synthetic polypeptide
DEGVACCTNPVAYAPWGSACSAANPATENDQMGTEM

SEQ ID NO: 209251 - protein, 39 aa, Artificial Sequence
  Description of Artificial Sequence: Synthetic polypeptide
AEECISTTNPVAYEQYGQCVCSNWGPDHNAEFFNSDTQA

SEQ ID NO: 209252 - protein, 40 aa, Artificial Sequence
  Description of Artificial Sequence: Synthetic polypeptide
DENEISCTNPVATEGYGQCQVCSTWEEDHNAENFNSEFQS

SEQ ID NO: 209253 - protein, 36 aa, Artificial Sequence
  Description of Artificial Sequence: Synthetic polypeptide
DDSEVASTNPVSTEGYGCVCGNWETNQEYFNSQTQA

SEQ ID NO: 209254 - protein, 39 aa, Artificial Sequence
  Description of Artificial Sequence: Synthetic polypeptide
AEEEISTTNPVATEGYGQCVCQNWGEDHNAENFNSDTQQ

SEQ ID NO: 209255 - protein, 37 aa, Artificial Sequence
  Description of Artificial Sequence: Synthetic polypeptide
NEMVIGTTNPVATEQYGCLCQATDGSPVEAFETNDKQ

SEQ ID NO: 209256 - protein, 36 aa, Artificial Sequence
  Description of Artificial Sequence: Synthetic polypeptide
NEMVIGTTNPVATEQYGCLCQATKGSPVEFETYDKQ

SEQ ID NO: 209257 - protein, 39 aa, Artificial Sequence
  Description of Artificial Sequence: Synthetic polypeptide
CEAEISTTNPVAYEGYGQCVCSNWGEDTNAEYFNSDTQL

SEQ ID NO: 209258 - protein, 36 aa, Artificial Sequence
  Description of Artificial Sequence: Synthetic polypeptide
DDSEVACTNPVSTEGYGCVCQTWGEHNIEYFGSQQS

SEQ ID NO: 209259 - protein, 37 aa, Artificial Sequence
  Description of Artificial Sequence: Synthetic polypeptide
NEMVIGTTNPVATEQYGCLCQATTGSPVEFETMDAKQ

SEQ ID NO: 209260 - protein, 37 aa, Artificial Sequence
  Description of Artificial Sequence: Synthetic polypeptide
DETEIRTTNPIATECWGATTWANAEDYWAEPKGLPYI

SEQ ID NO: 209261 - protein, 36 aa, Artificial Sequence
  Description of Artificial Sequence: Synthetic polypeptide
NEMVIGTTNPVATEQYGCLCQAWDRSAVEFETMDKQ

SEQ ID NO: 209262 - protein, 37 aa, Artificial Sequence
  Description of Artificial Sequence: Synthetic polypeptide
VEEEIACTNPVATAQWGANCAQNPIVNNTAGNPEGTA

SEQ ID NO: 209263 - protein, 36 aa, Artificial Sequence
  Description of Artificial Sequence: Synthetic polypeptide
NEMVIGTTNPVATEQYGCLCQKTDGSWVEFETMDKQ

SEQ ID NO: 209264 - protein, 36 aa, Artificial Sequence
  Description of Artificial Sequence: Synthetic polypeptide
DETEIATTNPIAYEPWGATTTALATDGPAEPKGPVN

SEQ ID NO: 209265 - protein, 36 aa, Artificial Sequence
  Description of Artificial Sequence: Synthetic polypeptide
NEMVIGTTNPVATEQYGCLCQNWDGSPVEFETMDKM

SEQ ID NO: 209266 - protein, 37 aa, Artificial Sequence
  Description of Artificial Sequence: Synthetic polypeptide
NEMVIGTTNPVATEQYGCLCQPTDGSPVEFFETMDKQ

SEQ ID NO: 209267 - protein, 37 aa, Artificial Sequence
  Description of Artificial Sequence: Synthetic polypeptide
DETEIRTTNPIATECWGATTWANAEDWYAEPKGEPYI

SEQ ID NO: 209268 - protein, 37 aa, Artificial Sequence
  Description of Artificial Sequence: Synthetic polypeptide
NEMVIGTTNPVATEQYGCLCTATDGSPVELFETMDKQ

SEQ ID NO: 209269 - protein, 39 aa, Artificial Sequence
  Description of Artificial Sequence: Synthetic polypeptide
CEAEISTTNPVAYEQYGQCVCSNWGEDHNAENFGSDTQS

SEQ ID NO: 209270 - protein, 39 aa, Artificial Sequence
  Description of Artificial Sequence: Synthetic polypeptide
CEAEISTTNPVAYEQYGQCVCSNWGEDHNAEYFGSETQS

SEQ ID NO: 209271 - protein, 38 aa, Artificial Sequence
  Description of Artificial Sequence: Synthetic polypeptide
DENCIRTTNPVSTEGYGQCICSNWEEDNAENFNSDNQS

SEQ ID NO: 209272 - protein, 36 aa, Artificial Sequence
  Description of Artificial Sequence: Synthetic polypeptide
NEMVIGTTNPVATEQYGCLHQATDGSPVEFETMDEQ

SEQ ID NO: 209273 - protein, 38 aa, Artificial Sequence
  Description of Artificial Sequence: Synthetic polypeptide
DENCIRTTNPVSTEGYGQCICSNWEEDNQEQFNSDTQS

SEQ ID NO: 209274 - protein, 39 aa, Artificial Sequence
  Description of Artificial Sequence: Synthetic polypeptide
DEECISTTNPVAYEEYGQCVCSNWGEDPNAENFNSDNQA

SEQ ID NO: 209275 - protein, 37 aa, Artificial Sequence
  Description of Artificial Sequence: Synthetic polypeptide
DETEIRTTNPIATECWGATTWANAEDWTAEPKGKPYI

SEQ ID NO: 209276 - protein, 37 aa, Artificial Sequence
  Description of Artificial Sequence: Synthetic polypeptide
DETEIRTTNPIATECWGATTWANAEDWPNEPKGMPYI

SEQ ID NO: 209277 - protein, 38 aa, Artificial Sequence
  Description of Artificial Sequence: Synthetic polypeptide
VEEEIACTNPVATEQWGNTTNAKNGNILTAPDNQDEGA

SEQ ID NO: 209278 - protein, 38 aa, Artificial Sequence
  Description of Artificial Sequence: Synthetic polypeptide
DEECISTTNPVAYEGYGICVCSNWVEDNAENFISDTQS

SEQ ID NO: 209279 - protein, 36 aa, Artificial Sequence
  Description of Artificial Sequence: Synthetic polypeptide
DETEIRTTNPIATECWGATTWANAEDWPAEPKMPYI

SEQ ID NO: 209280 - protein, 37 aa, Artificial Sequence
  Description of Artificial Sequence: Synthetic polypeptide
DETEIRTTNPIATECWGATTWANAEDWPAEPKGMPYI

SEQ ID NO: 209281 - protein, 39 aa, Artificial Sequence
  Description of Artificial Sequence: Synthetic polypeptide
AEEEISTTNPVATEGYGQCVCPNWMEDHNAENFNSDTQS

SEQ ID NO: 209282 - protein, 39 aa, Artificial Sequence
  Description of Artificial Sequence: Synthetic polypeptide
AEEEISTTNPVATEGYGQCVCGNWGEDHNTEHFNSDTQS

SEQ ID NO: 209283 - protein, 39 aa, Artificial Sequence
  Description of Artificial Sequence: Synthetic polypeptide
DEAAISTTNPVATEEYGQCVCSNWGEDPNAENFNSDNQS

SEQ ID NO: 209284 - protein, 39 aa, Artificial Sequence
  Description of Artificial Sequence: Synthetic polypeptide
AEEEISTTNPVATEGYGQCVCQNWGEDHNAENFNSETQG

SEQ ID NO: 209285 - protein, 39 aa, Artificial Sequence
  Description of Artificial Sequence: Synthetic polypeptide
AEEEISTTNPVATEGYGQCVCQNWGEDHNAENFNSQFQS

SEQ ID NO: 209286 - protein, 39 aa, Artificial Sequence
  Description of Artificial Sequence: Synthetic polypeptide
DEECISTTNPVAYEGYGQCQVCSNSGEHNAENFNSDTQA

SEQ ID NO: 209287 - protein, 38 aa, Artificial Sequence
  Description of Artificial Sequence: Synthetic polypeptide
DENEISTTNPVATEGWGQCVCSNSGPENAENFSSDTAS

SEQ ID NO: 209288 - protein, 39 aa, Artificial Sequence
  Description of Artificial Sequence: Synthetic polypeptide
DENEISTTNPVATEGWGICVCSNSGEDDNAEGSNSDTAS

SEQ ID NO: 209289 - protein, 39 aa, Artificial Sequence
  Description of Artificial Sequence: Synthetic polypeptide
DEECISTTNPVAYEGYGQCVCGNSGEDHNAENFNSDTQA

SEQ ID NO: 209290 - protein, 39 aa, Artificial Sequence
  Description of Artificial Sequence: Synthetic polypeptide
DEAAISTTNPVATEGYGQCVCSNWGEDDNAENFNSDNQS

SEQ ID NO: 209291 - protein, 36 aa, Artificial Sequence
  Description of Artificial Sequence: Synthetic polypeptide
DDSEVACTNPVSTEGYGCVCFNSGEINQEHFGSQQS

SEQ ID NO: 209292 - protein, 36 aa, Artificial Sequence
  Description of Artificial Sequence: Synthetic polypeptide
DDSEVACTNPVSTEGYGCVCFNWGEIQEYFGSQTQA

SEQ ID NO: 209293 - protein, 39 aa, Artificial Sequence
  Description of Artificial Sequence: Synthetic polypeptide
DEAEIATTNPVATEQWGGCCTAATAGWLTEAQADDKDSL

SEQ ID NO: 209294 - protein, 34 aa, Artificial Sequence
  Description of Artificial Sequence: Synthetic polypeptide
QEAEIACTNPCSYEQWGITCYCNDIQQDHGKTDG

SEQ ID NO: 209295 - protein, 39 aa, Artificial Sequence
  Description of Artificial Sequence: Synthetic polypeptide
DEAAISTTNPVATEGYGQCVCGTSGEDPNAENFNSDTQA

SEQ ID NO: 209296 - protein, 36 aa, Artificial Sequence
  Description of Artificial Sequence: Synthetic polypeptide
QETEIRTTNPIATECWGATTWANAEDWAEPKGGPYI

SEQ ID NO: 209297 - protein, 35 aa, Artificial Sequence
  Description of Artificial Sequence: Synthetic polypeptide
QEAEIACTNPCSYEQWGITCYCNDNQQDVGDTVRE

SEQ ID NO: 209298 - protein, 39 aa, Artificial Sequence
  Description of Artificial Sequence: Synthetic polypeptide
CEAEISTTNPVATEQWGQCVCSNSGEDHNAENFNSDTQS

SEQ ID NO: 209299 - protein, 39 aa, Artificial Sequence
  Description of Artificial Sequence: Synthetic polypeptide
CEAEISTTNPVATEQYGQCAVCGNWGEHNAENFGSDTQS

SEQ ID NO: 209300 - protein, 40 aa, Artificial Sequence
  Description of Artificial Sequence: Synthetic polypeptide
CEAEISTTNPVATEQYGQCQVCSNWGPDHNAENFNSDTQD

SEQ ID NO: 209301 - protein, 39 aa, Artificial Sequence
  Description of Artificial Sequence: Synthetic polypeptide
AEEEISTTNPVATEGYGQCVCGNWGEDHNAENFNSDNQS

SEQ ID NO: 209302 - protein, 39 aa, Artificial Sequence
  Description of Artificial Sequence: Synthetic polypeptide
QETEIRSTNPVATEFYGTVVMQDTFDQDFQDTGGFGQGG

SEQ ID NO: 209303 - protein, 36 aa, Artificial Sequence
  Description of Artificial Sequence: Synthetic polypeptide
QETEIATTNPVAYEAYGEHAPWCEHEFSQSGAEGEW

SEQ ID NO: 209304 - protein, 34 aa, Artificial Sequence
  Description of Artificial Sequence: Synthetic polypeptide
TECEIASTNPVGTEAWGVCAPTDRDQHQQQHQMM

SEQ ID NO: 209305 - protein, 37 aa, Artificial Sequence
  Description of Artificial Sequence: Synthetic polypeptide
QESQIAPTNPCSYEQYGVTVSCCGHMLSQNSNPGTDR

SEQ ID NO: 209306 - protein, 39 aa, Artificial Sequence
  Description of Artificial Sequence: Synthetic polypeptide
TEDEIRTTNPVAYEQWGVACYTGDELHNDIQNTQGQDDD

SEQ ID NO: 209307 - protein, 38 aa, Artificial Sequence
  Description of Artificial Sequence: Synthetic polypeptide
CEAEISTTNPVAYCQYGCVCSNWGEDHNAENFNSDTQA

SEQ ID NO: 209308 - protein, 37 aa, Artificial Sequence
  Description of Artificial Sequence: Synthetic polypeptide
DETEIRTTNPIATECWGATTWANAMDDWAEPKGVPKI

SEQ ID NO: 209309 - protein, 39 aa, Artificial Sequence
  Description of Artificial Sequence: Synthetic polypeptide
DENCIRTTNPVAYEQWGQCVTSNWGEDDNTENFISDTAS

SEQ ID NO: 209310 - protein, 36 aa, Artificial Sequence
  Description of Artificial Sequence: Synthetic polypeptide
NEMVIGTTNPVATEQYGCLCQATDGSFVEFEHMDKQ

SEQ ID NO: 209311 - protein, 39 aa, Artificial Sequence
  Description of Artificial Sequence: Synthetic polypeptide
AEEEISTTNPVATEGYGQCVCSNWGEDHNAENFISDTQS

SEQ ID NO: 209312 - protein, 39 aa, Artificial Sequence
  Description of Artificial Sequence: Synthetic polypeptide
AEEEISTTNPVATEGYGQCVCQNWGPDHNAENFNSETQA

SEQ ID NO: 209313 - protein, 38 aa, Artificial Sequence
  Description of Artificial Sequence: Synthetic polypeptide
CEAEISTTNPVAYEGYGCVCSNWGEDHNAEYFNSDTQS

SEQ ID NO: 209314 - protein, 36 aa, Artificial Sequence
  Description of Artificial Sequence: Synthetic polypeptide
DETEIATTNPIAYAPWGATTVALATDGPAQPKGPQN

SEQ ID NO: 209315 - protein, 40 aa, Artificial Sequence
  Description of Artificial Sequence: Synthetic polypeptide
FEVETIRTTTPVATECQWYVGSVALAIVYTEEVPRNVVCG

SEQ ID NO: 209316 - protein, 36 aa, Artificial Sequence
  Description of Artificial Sequence: Synthetic polypeptide
DDSEVACTNPVSTEGYGCVCQNWEEINQEHFGSQQM

SEQ ID NO: 209317 - protein, 36 aa, Artificial Sequence
  Description of Artificial Sequence: Synthetic polypeptide
DETEIRTTNPIATECWGATTWARAEDWAEPKGAPYI

SEQ ID NO: 209318 - protein, 38 aa, Artificial Sequence
  Description of Artificial Sequence: Synthetic polypeptide
FEGEIRATNPVATEQFGSWYQPAKDGWEHTETSIETNQ

SEQ ID NO: 209319 - protein, 37 aa, Artificial Sequence
  Description of Artificial Sequence: Synthetic polypeptide
DETEIRTTNPIATECWGATTWANAEDWWAEPKGPYIK

SEQ ID NO: 209320 - protein, 37 aa, Artificial Sequence
  Description of Artificial Sequence: Synthetic polypeptide
CEDEIACTNPVATEQWGGCCFKANGQNPETLENGEEA

SEQ ID NO: 209321 - protein, 37 aa, Artificial Sequence
  Description of Artificial Sequence: Synthetic polypeptide
CEDEIACTNPVATEQWGGCCFATGQFPETLENGEEAT

SEQ ID NO: 209322 - protein, 37 aa, Artificial Sequence
  Description of Artificial Sequence: Synthetic polypeptide
DENCIRTTNPVSYEGYGCICSNWEEDNAENFNSDTQS

SEQ ID NO: 209323 - protein, 36 aa, Artificial Sequence
  Description of Artificial Sequence: Synthetic polypeptide
DETEIRTTNPIATECWGATTWANAEDWAEPKVPYIL

SEQ ID NO: 209324 - protein, 38 aa, Artificial Sequence
  Description of Artificial Sequence: Synthetic polypeptide
DENEISTTNPVATEGWGCVCSNSGEEHNAEYSISDTAS

SEQ ID NO: 209325 - protein, 38 aa, Artificial Sequence
  Description of Artificial Sequence: Synthetic polypeptide
DENCISCTNPVATEGYGCVCSNWGEDHNIENFNSDTQS

SEQ ID NO: 209326 - protein, 37 aa, Artificial Sequence
  Description of Artificial Sequence: Synthetic polypeptide
DETEIATTNPTATECWGATTSANATDGPAEPKIGPYN

SEQ ID NO: 209327 - protein, 40 aa, Artificial Sequence
  Description of Artificial Sequence: Synthetic polypeptide
FEETLRTYITNMPIVATECTYTCSIISDNNEFPQMGVNFN

SEQ ID NO: 209328 - protein, 41 aa, Artificial Sequence
  Description of Artificial Sequence: Synthetic polypeptide
VEEEIQRTVNPVNSRYESYGCSTIPSCTNGSQNYTVGDNYA

SEQ ID NO: 209329 - protein, 39 aa, Artificial Sequence
  Description of Artificial Sequence: Synthetic polypeptide
DEAAISCTNPVATEQYGQCVCSNWGEDDNAENFNSDTQS

SEQ ID NO: 209330 - protein, 39 aa, Artificial Sequence
  Description of Artificial Sequence: Synthetic polypeptide
CEEEIGTTNPVAYEQYGQCVCQNWGEDHNTENFISDTQS

SEQ ID NO: 209331 - protein, 39 aa, Artificial Sequence
  Description of Artificial Sequence: Synthetic polypeptide
DEDEIATTNPVAYEQWGVTIICPAVAEAGQDHQGDNMEM

SEQ ID NO: 209332 - protein, 39 aa, Artificial Sequence
  Description of Artificial Sequence: Synthetic polypeptide
AEECISTTNPVAYEGYGQCVCSNWEEDHNAENFQSDNQS

SEQ ID NO: 209333 - protein, 38 aa, Artificial Sequence
  Description of Artificial Sequence: Synthetic polypeptide
AEEEISTTNPCATEGWGQCVCSNWGEHNAENFNSENQL

SEQ ID NO: 209334 - protein, 36 aa, Artificial Sequence
  Description of Artificial Sequence: Synthetic polypeptide
DETEIRTTNPIATECWGATTWANAEDWAEPKSLPYI

SEQ ID NO: 209335 - protein, 36 aa, Artificial Sequence
  Description of Artificial Sequence: Synthetic polypeptide
NEMVISTTNPVATEQYGCLCQEWDGSPVEFETMDKQ

SEQ ID NO: 209336 - protein, 39 aa, Artificial Sequence
  Description of Artificial Sequence: Synthetic polypeptide
DEAAIRTTNPVAYEYYGQCVCSNWEEDHNAENFNSDTQS

SEQ ID NO: 209337 - protein, 36 aa, Artificial Sequence
  Description of Artificial Sequence: Synthetic polypeptide
DDSEVASTNPVSTEGYGCVCENSGEINQEYFGSQQA

SEQ ID NO: 209338 - protein, 39 aa, Artificial Sequence
  Description of Artificial Sequence: Synthetic polypeptide
AEECISTTNPVAYEGYGQCVCSNWGEAHNAENFQSENQA

SEQ ID NO: 209339 - protein, 36 aa, Artificial Sequence
  Description of Artificial Sequence: Synthetic polypeptide
DETEIRTTNPIATECWGATTWANAEDWAEPKLPYIK

SEQ ID NO: 209340 - protein, 36 aa, Artificial Sequence
  Description of Artificial Sequence: Synthetic polypeptide
DETEIRTTNPIATECWGATTWANAEDWAEPKKPYIN

SEQ ID NO: 209341 - protein, 37 aa, Artificial Sequence
  Description of Artificial Sequence: Synthetic polypeptide
QEEEIATTNPVAYESYGEHAPWCEHEFSIHAEGENWD

SEQ ID NO: 209342 - protein, 39 aa, Artificial Sequence
  Description of Artificial Sequence: Synthetic polypeptide
CENEISTTNPVATEQYGQCVCPNWGEDDNAENFNSDNQS

SEQ ID NO: 209343 - protein, 36 aa, Artificial Sequence
  Description of Artificial Sequence: Synthetic polypeptide
DETEIRTTNPIATECWGATTWANAEDWAEPKAEPYI

SEQ ID NO: 209344 - protein, 37 aa, Artificial Sequence
  Description of Artificial Sequence: Synthetic polypeptide
DETEIRTTNPIATECWGATTWANAEDSWAEPKGWPYI

SEQ ID NO: 209345 - protein, 37 aa, Artificial Sequence
  Description of Artificial Sequence: Synthetic polypeptide
NENEIATTNPVAYEAWGVVWPGPNNENDSGIQNNGEG

SEQ ID NO: 209346 - protein, 37 aa, Artificial Sequence
  Description of Artificial Sequence: Synthetic polypeptide
DETEIRTTNPIATECWGATTWANAEDSWAEPKGPYIN

SEQ ID NO: 209347 - protein, 39 aa, Artificial Sequence
  Description of Artificial Sequence: Synthetic polypeptide
AEECISTTNPVAYEQYGQCVCSNWMEDDNTENFNSETQA

SEQ ID NO: 209348 - protein, 36 aa, Artificial Sequence
  Description of Artificial Sequence: Synthetic polypeptide
CEDEIACTNPVATEQWGCVAGQGVGPAEAAAQGIDD

SEQ ID NO: 209349 - protein, 36 aa, Artificial Sequence
  Description of Artificial Sequence: Synthetic polypeptide
DETEIATTNPIAYEPWGATTWAVATDGPAEPKGPQN

SEQ ID NO: 209350 - protein, 42 aa, Artificial Sequence
  Description of Artificial Sequence: Synthetic polypeptide
NETEEEIRATNPVAYEQWGTIAEPYGTVSWNESQQRIGTTDM

SEQ ID NO: 209351 - protein, 39 aa, Artificial Sequence
  Description of Artificial Sequence: Synthetic polypeptide
AEEEISTTNPVATEEYGQCVCGNWGEDHNAENFNSDTQI

SEQ ID NO: 209352 - protein, 36 aa, Artificial Sequence
  Description of Artificial Sequence: Synthetic polypeptide
DETEIRTTNPIATECWGATTWANAEDWEAEPKEPYI

SEQ ID NO: 209353 - protein, 40 aa, Artificial Sequence
  Description of Artificial Sequence: Synthetic polypeptide
AEEEISTTNPVATEGYGQCQVCSNWGEDDNIENFNSDNQS

SEQ ID NO: 209354 - protein, 36 aa, Artificial Sequence
  Description of Artificial Sequence: Synthetic polypeptide
CEDEIACTNPVATEQWGCIAGNGVGPAEATAQGIDS

SEQ ID NO: 209355 - protein, 40 aa, Artificial Sequence
  Description of Artificial Sequence: Synthetic polypeptide
AEEEISTTNPVATEGYGQCQVCGNSGEDHNTENFGSETQA

SEQ ID NO: 209356 - protein, 40 aa, Artificial Sequence
  Description of Artificial Sequence: Synthetic polypeptide
AEEEISTTNPVATEGYGQCAVCSNWGEDHNAENFGSETQS

SEQ ID NO: 209357 - protein, 36 aa, Artificial Sequence
  Description of Artificial Sequence: Synthetic polypeptide
DETEIRTTNPIATECWGATTWANAEDWDAEPKCPYI

SEQ ID NO: 209358 - protein, 37 aa, Artificial Sequence
  Description of Artificial Sequence: Synthetic polypeptide
DETEIATTNPIAYEPWGATTVANATDGPAEPAGNPQN

SEQ ID NO: 209359 - protein, 40 aa, Artificial Sequence
  Description of Artificial Sequence: Synthetic polypeptide
AEEEISTTNPVATEGYGQCQVCSNWGEDHNAENFNSDTQS

SEQ ID NO: 209360 - protein, 39 aa, Artificial Sequence
  Description of Artificial Sequence: Synthetic polypeptide
ADACISTTNPVATEQYGQCSCSMWGEDDNAENFISENQS

SEQ ID NO: 209361 - protein, 39 aa, Artificial Sequence
  Description of Artificial Sequence: Synthetic polypeptide
ADACISTTNPVATEQYGQCVCSNWGEDHNAEYFNSDNQA

SEQ ID NO: 209362 - protein, 37 aa, Artificial Sequence
  Description of Artificial Sequence: Synthetic polypeptide
ADACISTTNPVAYEGYGCVCSNWGEHNTEHFNSDNQL

SEQ ID NO: 209363 - protein, 38 aa, Artificial Sequence
  Description of Artificial Sequence: Synthetic polypeptide
DDEEISCTNPCAYEGYGQCVCSNWEEHNAEGFNSDTQS

SEQ ID NO: 209364 - protein, 39 aa, Artificial Sequence
  Description of Artificial Sequence: Synthetic polypeptide
CEMEISTTNPVAYEQYGQCVCSNWGEDHNAENFFSDTQA

SEQ ID NO: 209365 - protein, 38 aa, Artificial Sequence
  Description of Artificial Sequence: Synthetic polypeptide
DENCIRTTNPVSTEGYGQCICSNWEEHNAENFISDTQS

SEQ ID NO: 209366 - protein, 39 aa, Artificial Sequence
  Description of Artificial Sequence: Synthetic polypeptide
DEMCISTTNPVATEQWGQCVCQNWGEDHNAENFNSDTQS

SEQ ID NO: 209367 - protein, 39 aa, Artificial Sequence
  Description of Artificial Sequence: Synthetic polypeptide
ADAAIGTTNPVAYEQYGQCVCSNWPEDHNTENFNSDNAA

SEQ ID NO: 209368 - protein, 39 aa, Artificial Sequence
  Description of Artificial Sequence: Synthetic polypeptide
NEAEIGTTNPVATEGYGQCVCSNWGEDHNDEFFISDTQS

SEQ ID NO: 209369 - protein, 39 aa, Artificial Sequence
  Description of Artificial Sequence: Synthetic polypeptide
DENCIRTTNPVAYEQWGICVCSNSGEDDNAEYSISDTAS

SEQ ID NO: 209370 - protein, 39 aa, Artificial Sequence
  Description of Artificial Sequence: Synthetic polypeptide
DEAEISTTNPVAYEGYGQCVCSNWGEDHNAENFISETQA

SEQ ID NO: 209371 - protein, 39 aa, Artificial Sequence
  Description of Artificial Sequence: Synthetic polypeptide
CEMAIGTTNPVAYEQYGQCVCQNWGEDHNTENFFSDNQQ

SEQ ID NO: 209372 - protein, 39 aa, Artificial Sequence
  Description of Artificial Sequence: Synthetic polypeptide
DEAEISTTNPVAYEGYGQCVCSNWGEDHNIENFISDTQS

SEQ ID NO: 209373 - protein, 39 aa, Artificial Sequence
  Description of Artificial Sequence: Synthetic polypeptide
ADACISTTNPVATCQYGQCVCSNWGEDHNAENFGSDNQA

SEQ ID NO: 209374 - protein, 39 aa, Artificial Sequence
  Description of Artificial Sequence: Synthetic polypeptide
AEEEISTTNPVAYEQYGQCYCQNWGEDHNAENFNSDNQS

SEQ ID NO: 209375 - protein, 39 aa, Artificial Sequence
  Description of Artificial Sequence: Synthetic polypeptide
DESEICTTNCVATEAYGAAGNGAGDDNDGEQQGGPEGAQ

SEQ ID NO: 209376 - protein, 39 aa, Artificial Sequence
  Description of Artificial Sequence: Synthetic polypeptide
CEMEISTTNPVAYEGYGQCVCSNWEEDPNTEGFNSDTQS

SEQ ID NO: 209377 - protein, 40 aa, Artificial Sequence
  Description of Artificial Sequence: Synthetic polypeptide
DENCISTTNPVATEGYGQCQVCSNWGEDHNTESFNSDNQA

SEQ ID NO: 209378 - protein, 38 aa, Artificial Sequence
  Description of Artificial Sequence: Synthetic polypeptide
ADACISTTNPVATEGYGQCVCSNSGEHNAEYFNSDNQA

SEQ ID NO: 209379 - protein, 38 aa, Artificial Sequence
  Description of Artificial Sequence: Synthetic polypeptide
DENCIRTTNPVAYEGWGQCVTSNWGEDNTEYFISDTAS

SEQ ID NO: 209380 - protein, 39 aa, Artificial Sequence
  Description of Artificial Sequence: Synthetic polypeptide
DENCISTTNPVATEGWGQCVTSNWMEDENTENFISDTAS

SEQ ID NO: 209381 - protein, 39 aa, Artificial Sequence
  Description of Artificial Sequence: Synthetic polypeptide
DDEEISTTNPCAYEGYGQCVCSNWGEEHNTENSNSDTQA

SEQ ID NO: 209382 - protein, 39 aa, Artificial Sequence
  Description of Artificial Sequence: Synthetic polypeptide
DENCISTTNPVATEGWGQCVTSNSMEDENAEHFNSDTAA

SEQ ID NO: 209383 - protein, 39 aa, Artificial Sequence
  Description of Artificial Sequence: Synthetic polypeptide
DEAEISTTNPVAYEGYGQCVCSNWGEDHNAENFPSDTQS

SEQ ID NO: 209384 - protein, 39 aa, Artificial Sequence
  Description of Artificial Sequence: Synthetic polypeptide
ADACISTTNPVATEQYGQCVCSNWGEGHNTEHFNSDTQL

SEQ ID NO: 209385 - protein, 40 aa, Artificial Sequence
  Description of Artificial Sequence: Synthetic polypeptide
SEEEIATTNPVATEQWGCTNNQANGNGVDTATANIDEEWD

SEQ ID NO: 209386 - protein, 40 aa, Artificial Sequence
  Description of Artificial Sequence: Synthetic polypeptide
ADAEIRTTNPVATEQWGQCQVCSNWGEDHNAENSNSENQS

SEQ ID NO: 209387 - protein, 39 aa, Artificial Sequence
  Description of Artificial Sequence: Synthetic polypeptide
ADACIRTTNPVAYEQYGQCVCSNWGEDPNAENFNSDTQS

SEQ ID NO: 209388 - protein, 39 aa, Artificial Sequence
  Description of Artificial Sequence: Synthetic polypeptide
ADAEIGTTNPVATEGYGQCVCSNWGEDHNAENFISDNQP

SEQ ID NO: 209389 - protein, 39 aa, Artificial Sequence
  Description of Artificial Sequence: Synthetic polypeptide
MGERYVIRCTNPVAYEQYGGYFSVEDEIMENEFFYNLTF

SEQ ID NO: 209390 - protein, 35 aa, Artificial Sequence
  Description of Artificial Sequence: Synthetic polypeptide
DSTEIATTNPIATGCWGATAWANAEDWAEPKRPYI

SEQ ID NO: 209391 - protein, 37 aa, Artificial Sequence
  Description of Artificial Sequence: Synthetic polypeptide
NEAVIGTTNPVATEQYGCTLCQAWDGSPVEFETMDKQ

SEQ ID NO: 209392 - protein, 37 aa, Artificial Sequence
  Description of Artificial Sequence: Synthetic polypeptide
MIELNCIRTTNPVCTEFLGCVWAPWQEDETESDQNDV

SEQ ID NO: 209393 - protein, 39 aa, Artificial Sequence
  Description of Artificial Sequence: Synthetic polypeptide
DENCISTTNPVATEQWGQCVCSNSGEDDNAENSSSDTAA

SEQ ID NO: 209394 - protein, 39 aa, Artificial Sequence
  Description of Artificial Sequence: Synthetic polypeptide
DDECISTTNPVATEAYGQCVCGNWGEDHNAEHSNSDNQS

SEQ ID NO: 209395 - protein, 38 aa, Artificial Sequence
  Description of Artificial Sequence: Synthetic polypeptide
DENCISTTNPCAYEGYGCVCSNWGEDHNAENFNSDTQS

SEQ ID NO: 209396 - protein, 38 aa, Artificial Sequence
  Description of Artificial Sequence: Synthetic polypeptide
ADACISTTNPVATEQYGCVCGNWGEDHNAENFISDTQA

SEQ ID NO: 209397 - protein, 38 aa, Artificial Sequence
  Description of Artificial Sequence: Synthetic polypeptide
CEMCISTTNPVATEGWGQCVCSNWGEHNAENFNSDTQS

SEQ ID NO: 209398 - protein, 38 aa, Artificial Sequence
  Description of Artificial Sequence: Synthetic polypeptide
CEEEIACTNPVATEQWGTNCIATGGMNPETHPMDLAVM

SEQ ID NO: 209399 - protein, 38 aa, Artificial Sequence
  Description of Artificial Sequence: Synthetic polypeptide
QESEIAPTNPCSYEQYGVTVQSCCWHMGSQNSNGGTDR

SEQ ID NO: 209400 - protein, 39 aa, Artificial Sequence
  Description of Artificial Sequence: Synthetic polypeptide
DEAEISTTNPVAYEGYGQCYCGNWGEDDNIENFNSDTQS

SEQ ID NO: 209401 - protein, 39 aa, Artificial Sequence
  Description of Artificial Sequence: Synthetic polypeptide
DENCISTTNPVATEGYGQCVCENWGPDHNAENFNSDTQA

SEQ ID NO: 209402 - protein, 39 aa, Artificial Sequence
  Description of Artificial Sequence: Synthetic polypeptide
DENCIRTTNPVSTEGYGQCICSNWEEDDNAEQFSSDTQS

SEQ ID NO: 209403 - protein, 40 aa, Artificial Sequence
  Description of Artificial Sequence: Synthetic polypeptide
DDECISTTNPVATEGYGQCIVCSNWGYDHNAESFNSENQA

SEQ ID NO: 209404 - protein, 39 aa, Artificial Sequence
  Description of Artificial Sequence: Synthetic polypeptide
DEAEIATTNGVAYCQYGQCVCSNWMEDHNAENFNSDTQA

SEQ ID NO: 209405 - protein, 39 aa, Artificial Sequence
  Description of Artificial Sequence: Synthetic polypeptide
DEAEISTTNPVAYEGYGQCVCSNWGEDHNAENFISDFQS

SEQ ID NO: 209406 - protein, 39 aa, Artificial Sequence
  Description of Artificial Sequence: Synthetic polypeptide
DEAEISTTNPVAYEGYGQCVCSNWGEDHNAENFFSETQA

SEQ ID NO: 209407 - protein, 38 aa, Artificial Sequence
  Description of Artificial Sequence: Synthetic polypeptide
CEGEIATTNPVAYEQWGHCIIFAGNSGLVDNDGEQDAM

SEQ ID NO: 209408 - protein, 37 aa, Artificial Sequence
  Description of Artificial Sequence: Synthetic polypeptide
NEEEIACTNPVATAPWGGCSAANNGDPTDSPGGQTHK

SEQ ID NO: 209409 - protein, 39 aa, Artificial Sequence
  Description of Artificial Sequence: Synthetic polypeptide
ADECIRTTNPVATEGYGQCVCGNWGEDHNAENFNSDTQI

SEQ ID NO: 209410 - protein, 37 aa, Artificial Sequence
  Description of Artificial Sequence: Synthetic polypeptide
YPHETRATNPEATHGYYGSVGPTTHYDLQQNYMTTAK

SEQ ID NO: 209411 - protein, 38 aa, Artificial Sequence
  Description of Artificial Sequence: Synthetic polypeptide
QESEIAPTNPCSYEQWGVTVSCWGHMLSQNSNGGTDRV

SEQ ID NO: 209412 - protein, 40 aa, Artificial Sequence
  Description of Artificial Sequence: Synthetic polypeptide
MESTECVTTNHPDAMEQYQGASIVCSFYMHLEAGSTEPRA

SEQ ID NO: 209413 - protein, 38 aa, Artificial Sequence
  Description of Artificial Sequence: Synthetic polypeptide
ADACISTTNPVATEGYGQCVCSWGEDHNTEHFNSDNQL

SEQ ID NO: 209414 - protein, 38 aa, Artificial Sequence
  Description of Artificial Sequence: Synthetic polypeptide
ADACISTTNPVATEGYGQCVCSNWGEDNAEGFNSETQS

SEQ ID NO: 209415 - protein, 39 aa, Artificial Sequence
  Description of Artificial Sequence: Synthetic polypeptide
DEAEISTTNPVAYEGYGQCVCSNWGEDHNAENFISDTQA

SEQ ID NO: 209416 - protein, 39 aa, Artificial Sequence
  Description of Artificial Sequence: Synthetic polypeptide
DENCISTTNPVATEQWGQCVTSNWGEADNTEYFISDTAS

SEQ ID NO: 209417 - protein, 39 aa, Artificial Sequence
  Description of Artificial Sequence: Synthetic polypeptide
DDECISTTNPVATEGYGQCVCGNSGEDHNAENFSSDTQS

SEQ ID NO: 209418 - protein, 38 aa, Artificial Sequence
  Description of Artificial Sequence: Synthetic polypeptide
AENEIACTNPVATEGYGCVCSNWGEDDNQEHFISETQA

SEQ ID NO: 209419 - protein, 39 aa, Artificial Sequence
  Description of Artificial Sequence: Synthetic polypeptide
DDECISTTNPVATEGYGQCVCGMWGEDHNAEFFISQNQS

SEQ ID NO: 209420 - protein, 38 aa, Artificial Sequence
  Description of Artificial Sequence: Synthetic polypeptide
DENCIRTTNPVSTEGYGCICSNWEEDHNAEHFISDTQS

SEQ ID NO: 209421 - protein, 38 aa, Artificial Sequence
  Description of Artificial Sequence: Synthetic polypeptide
ADACISTTNPVATEGYGQCVCSNWGEHNAEYFNSDTQP

SEQ ID NO: 209422 - protein, 39 aa, Artificial Sequence
  Description of Artificial Sequence: Synthetic polypeptide
ADACISTTNPVATEQYGQCVCSNWGEDTNAENFISDTQS

SEQ ID NO: 209423 - protein, 39 aa, Artificial Sequence
  Description of Artificial Sequence: Synthetic polypeptide
DEAVIATTNPVAYEQYGICVCENWGEDPNAEYFGSDTQS

SEQ ID NO: 209424 - protein, 40 aa, Artificial Sequence
  Description of Artificial Sequence: Synthetic polypeptide
NETEEEICATNPLAYEQWGCIMEPWGVVSWNDSQRGQTQM

SEQ ID NO: 209425 - protein, 39 aa, Artificial Sequence
  Description of Artificial Sequence: Synthetic polypeptide
AEMCISTTNPVAYEGYGQCVCSTWGEDHNAENFISDNQS

SEQ ID NO: 209426 - protein, 39 aa, Artificial Sequence
  Description of Artificial Sequence: Synthetic polypeptide
AEMCISTTNPVAYEGYGQCVCSTWGEDPNAEHFNSETQS

SEQ ID NO: 209427 - protein, 38 aa, Artificial Sequence
  Description of Artificial Sequence: Synthetic polypeptide
AEMCISTTNPVAYEQYGCVCPNWGEDHNAENFNSDTQA

SEQ ID NO: 209428 - protein, 39 aa, Artificial Sequence
  Description of Artificial Sequence: Synthetic polypeptide
AEMEISTTNPVAYEGYGQCVCSNWGEDHNAENSNSDTQG

SEQ ID NO: 209429 - protein, 39 aa, Artificial Sequence
  Description of Artificial Sequence: Synthetic polypeptide
AEMEISTTNPVAYEGYGQCVCSNWGEDDNAENFNSDNQG

SEQ ID NO: 209430 - protein, 40 aa, Artificial Sequence
  Description of Artificial Sequence: Synthetic polypeptide
AEMCISTTNPVAYEQYGQCQVCSNWMEDHNTENFNSDNQA

SEQ ID NO: 209431 - protein, 38 aa, Artificial Sequence
  Description of Artificial Sequence: Synthetic polypeptide
AEMCISTTNPVAYEGYGQCVCSNWGEHNAENFNSQTQL

SEQ ID NO: 209432 - protein, 38 aa, Artificial Sequence
  Description of Artificial Sequence: Synthetic polypeptide
AEMCISTTNPVAYEQYGQCVCGNWGEHNAENFNSDTQN

SEQ ID NO: 209433 - protein, 39 aa, Artificial Sequence
  Description of Artificial Sequence: Synthetic polypeptide
AEMCISTTNPVAYEQYGQCVCSDWEPDHNAENFNSDFQS

SEQ ID NO: 209434 - protein, 39 aa, Artificial Sequence
  Description of Artificial Sequence: Synthetic polypeptide
AEMCISTTNPVAYEQYGQCVCSNSGEDHNAENFNSDTQA

SEQ ID NO: 209435 - protein, 39 aa, Artificial Sequence
  Description of Artificial Sequence: Synthetic polypeptide
DEMCISCTNPVAYEQYGQCVCSNWEEDHNIENFNSDPQA

SEQ ID NO: 209436 - protein, 39 aa, Artificial Sequence
  Description of Artificial Sequence: Synthetic polypeptide
DEMCISCTNPVAYEQYGQCVCSNWGEDDNAEGFNSENQA

SEQ ID NO: 209437 - protein, 39 aa, Artificial Sequence
  Description of Artificial Sequence: Synthetic polypeptide
AEMCISTTNPVAYEQYGQCVCSNWGEDHNAENFLSENQA

SEQ ID NO: 209438 - protein, 39 aa, Artificial Sequence
  Description of Artificial Sequence: Synthetic polypeptide
AEMEISTTNPVAYEGYGQCVCSMWGEDHNAENFNSDFQI

SEQ ID NO: 209439 - protein, 39 aa, Artificial Sequence
  Description of Artificial Sequence: Synthetic polypeptide
AEMEISTTNPVAYEGYGQCVCSNWEEDHNAENFQSDTQS

SEQ ID NO: 209440 - protein, 39 aa, Artificial Sequence
  Description of Artificial Sequence: Synthetic polypeptide
DEMCISCTNPVAYEQYGQCVCSNWEEDHNAENFISDNQS

SEQ ID NO: 209441 - protein, 38 aa, Artificial Sequence
  Description of Artificial Sequence: Synthetic polypeptide
AEMCISTTNPVAYEGYGCVCSNWGEDHNAENFNSDNQS

SEQ ID NO: 209442 - protein, 40 aa, Artificial Sequence
  Description of Artificial Sequence: Synthetic polypeptide
DDEEIRCTNPVAYEGYGQCQVCSNSGEDHNAENFNSDTQS

SEQ ID NO: 209443 - protein, 39 aa, Artificial Sequence
  Description of Artificial Sequence: Synthetic polypeptide
AEMCISTTNPVATEGYGQCVCSNWGEGHNAENFNSDTQS

SEQ ID NO: 209444 - protein, 38 aa, Artificial Sequence
  Description of Artificial Sequence: Synthetic polypeptide
NEMVISTTNPVATEQYGQCLCQAWDGSPVEFETMDSKQ

SEQ ID NO: 209445 - protein, 40 aa, Artificial Sequence
  Description of Artificial Sequence: Synthetic polypeptide
AEMCISTTNPVATEQYGQCAVCSNWGEPHNAENFNSETQS

SEQ ID NO: 209446 - protein, 38 aa, Artificial Sequence
  Description of Artificial Sequence: Synthetic polypeptide
ADAEISTTNPVAYEGYGQCVCSNWGEHNAEYFISENQS

SEQ ID NO: 209447 - protein, 37 aa, Artificial Sequence
  Description of Artificial Sequence: Synthetic polypeptide
NEMVIGTTNPVATEQYGQCLCQVWDGPPVEFETMDKQ

SEQ ID NO: 209448 - protein, 39 aa, Artificial Sequence
  Description of Artificial Sequence: Synthetic polypeptide
AEMEISTTNPVAYEQYGQCVCSMWGEDHNAENFISETQS

SEQ ID NO: 209449 - protein, 39 aa, Artificial Sequence
  Description of Artificial Sequence: Synthetic polypeptide
AEMCISTTNPVATEQYGQCVCGNWGEDHNAENSNSDTQS

SEQ ID NO: 209450 - protein, 39 aa, Artificial Sequence
  Description of Artificial Sequence: Synthetic polypeptide
DENAISTTNPVAYEGYGQCVCSNWGEDHNAEGFNSDTQM

SEQ ID NO: 209451 - protein, 39 aa, Artificial Sequence
  Description of Artificial Sequence: Synthetic polypeptide
AEMEISTTNPVAYEQYGQCVCQNWGEDHNIESFNSETQS

SEQ ID NO: 209452 - protein, 38 aa, Artificial Sequence
  Description of Artificial Sequence: Synthetic polypeptide
NEMVIGTTNPVATEQYGQCLCQAWDGSPVEFETMDQKE

SEQ ID NO: 209453 - protein, 40 aa, Artificial Sequence
  Description of Artificial Sequence: Synthetic polypeptide
DENAISTTNPVAYEQYGQCQVCSNWGEDHNAEYFNSDNQN

SEQ ID NO: 209454 - protein, 39 aa, Artificial Sequence
  Description of Artificial Sequence: Synthetic polypeptide
AEMEISTTNPVAYEQYGQCVCGNWGEDHNIEYFNSETQA

SEQ ID NO: 209455 - protein, 37 aa, Artificial Sequence
  Description of Artificial Sequence: Synthetic polypeptide
NEMVIGTTNPVATEQYGNCLCQAWDGSPVEFETMDKQ

SEQ ID NO: 209456 - protein, 40 aa, Artificial Sequence
  Description of Artificial Sequence: Synthetic polypeptide
AEMEISTTNPVAYEQYGQCQVCSDWEYDHNAENFNSETQA

SEQ ID NO: 209457 - protein, 38 aa, Artificial Sequence
  Description of Artificial Sequence: Synthetic polypeptide
DEMCISCTNPVAYEGYGQCVCSNSGEHNAENFNSDTQA

SEQ ID NO: 209458 - protein, 39 aa, Artificial Sequence
  Description of Artificial Sequence: Synthetic polypeptide
AEMEISTTNPVAYEGYGQCVCSMWEEDHNAESFNSDNQS

SEQ ID NO: 209459 - protein, 39 aa, Artificial Sequence
  Description of Artificial Sequence: Synthetic polypeptide
AEMEISTTNPVAYEGYGQCVCSDWGEDHNTENFNSDTQA

SEQ ID NO: 209460 - protein, 38 aa, Artificial Sequence
  Description of Artificial Sequence: Synthetic polypeptide
AEMEISTTNPVAYEGYGQCVCPNWGEHNAENFNSQFQS

SEQ ID NO: 209461 - protein, 39 aa, Artificial Sequence
  Description of Artificial Sequence: Synthetic polypeptide
AEMCISTTNPVAYEQYGQCVCSNWGEDHNIEGFNSDTQA

SEQ ID NO: 209462 - protein, 40 aa, Artificial Sequence
  Description of Artificial Sequence: Synthetic polypeptide
AEMEISCTNPVATEQYGQCQVCSNWGEPHNAENFNSEFQS

SEQ ID NO: 209463 - protein, 37 aa, Artificial Sequence
  Description of Artificial Sequence: Synthetic polypeptide
AEMEIACTNPVGYEGYGVSCGNSGEHNAEHFNSDTQS

SEQ ID NO: 209464 - protein, 39 aa, Artificial Sequence
  Description of Artificial Sequence: Synthetic polypeptide
AEMEISCTNPVATEGYGQCVCSNSGEDHNAEHFNSDNQS

SEQ ID NO: 209465 - protein, 38 aa, Artificial Sequence
  Description of Artificial Sequence: Synthetic polypeptide
AEMEIASTNPVGTEGYGQCSCGNSGEHNQEHFGSDTQS

SEQ ID NO: 209466 - protein, 39 aa, Artificial Sequence
  Description of Artificial Sequence: Synthetic polypeptide
AEMEISCTNPVATEGYGQCVCSDWGEDHNTENFNSDTQS

SEQ ID NO: 209467 - protein, 40 aa, Artificial Sequence
  Description of Artificial Sequence: Synthetic polypeptide
CEEEIACTNPVATEQWGCSVVATPTGPGVEATAEDPGEDF

SEQ ID NO: 209468 - protein, 39 aa, Artificial Sequence
  Description of Artificial Sequence: Synthetic polypeptide
DEAEISTTNPVAYEGWGQCVCSNWGEDHNAENSNSDTQS

SEQ ID NO: 209469 - protein, 37 aa, Artificial Sequence
  Description of Artificial Sequence: Synthetic polypeptide
NEMVIGTTNPVATEQWGCLCQAWDGSPVEFETMDTKQ

SEQ ID NO: 209470 - protein, 37 aa, Artificial Sequence
  Description of Artificial Sequence: Synthetic polypeptide
CEEEIACTNPVATEQWGCTTIFAGAGMHGPDDSAEGA

SEQ ID NO: 209471 - protein, 39 aa, Artificial Sequence
  Description of Artificial Sequence: Synthetic polypeptide
DEAEISTTNPVAYCGYGQCVCSNSGEDHNAENFNSDNQA

SEQ ID NO: 209472 - protein, 39 aa, Artificial Sequence
  Description of Artificial Sequence: Synthetic polypeptide
DEAEISTTNPVAYCQYGQCVCGNWGEDHNAENFNSDTQG

SEQ ID NO: 209473 - protein, 38 aa, Artificial Sequence
  Description of Artificial Sequence: Synthetic polypeptide
CEEEIACTNPVATEQWGCTYIFAGAGMHGPDDSGEGAQ

SEQ ID NO: 209474 - protein, 38 aa, Artificial Sequence
  Description of Artificial Sequence: Synthetic polypeptide
DEESIACTNPVAYEPQWGPCIAGTGTGDHSTAGADMNF

SEQ ID NO: 209475 - protein, 39 aa, Artificial Sequence
  Description of Artificial Sequence: Synthetic polypeptide
DEAEISTTNPVAYCGYGQCVCSNWGEDHNAENFNSDTQA

SEQ ID NO: 209476 - protein, 40 aa, Artificial Sequence
  Description of Artificial Sequence: Synthetic polypeptide
DEEEIATTNPVATEQWGCTNNQANMNDVDTATAGEDEEWP

SEQ ID NO: 209477 - protein, 40 aa, Artificial Sequence
  Description of Artificial Sequence: Synthetic polypeptide
DEESIATTNPVATEQWGCTNNQANGNGVDTATANIDEEQP

SEQ ID NO: 209478 - protein, 39 aa, Artificial Sequence
  Description of Artificial Sequence: Synthetic polypeptide
ADAEISTTNPVAYEQYGQCVCSNWGEDHNAEGFNSDTQA

SEQ ID NO: 209479 - protein, 38 aa, Artificial Sequence
  Description of Artificial Sequence: Synthetic polypeptide
NEMEISTTNPVAYEGYGCVCSNWGEDHNDEFFISDTQS

SEQ ID NO: 209480 - protein, 39 aa, Artificial Sequence
  Description of Artificial Sequence: Synthetic polypeptide
AEMEISCTNPVATEQYGQCVCGNWGEDHNAENFNSQNQS

SEQ ID NO: 209481 - protein, 38 aa, Artificial Sequence
  Description of Artificial Sequence: Synthetic polypeptide
AEMCISTTNPVAYEQYGQCVCSNWGEPNAEFFISDTQA

SEQ ID NO: 209482 - protein, 37 aa, Artificial Sequence
  Description of Artificial Sequence: Synthetic polypeptide
AEMEIACTNPCSYEQYGCVCSNWGEHNAESFGSETQS

SEQ ID NO: 209483 - protein, 37 aa, Artificial Sequence
  Description of Artificial Sequence: Synthetic polypeptide
AEMEIACTNPCSYEQYGCVCSNWMEDNQESFGSETQS

SEQ ID NO: 209484 - protein, 39 aa, Artificial Sequence
  Description of Artificial Sequence: Synthetic polypeptide
ADAEISTTNPVAYEEYGQCVCSNWGEGTNAENFNSETQS

SEQ ID NO: 209485 - protein, 40 aa, Artificial Sequence
  Description of Artificial Sequence: Synthetic polypeptide
DEAEISTTNPVAYEGYGQCIVCSNWMEDHNTENFNSETQS

SEQ ID NO: 209486 - protein, 36 aa, Artificial Sequence
  Description of Artificial Sequence: Synthetic polypeptide
DDSEVASTNPVSYEGYGCVCGTWGEHNQENFGSQQA

SEQ ID NO: 209487 - protein, 40 aa, Artificial Sequence
  Description of Artificial Sequence: Synthetic polypeptide
AEMEISTTNPVATEQYGQCQVCGNWGEDHNAENFNSDTQS

SEQ ID NO: 209488 - protein, 40 aa, Artificial Sequence
  Description of Artificial Sequence: Synthetic polypeptide
DEAEISTTNPVAYEGYGQCAVCSNWEEDHNAENFNSETQS

SEQ ID NO: 209489 - protein, 39 aa, Artificial Sequence
  Description of Artificial Sequence: Synthetic polypeptide
AEMEISTTNPVATEQWGQCVCGNWGEDHNAENFNSDNQI

SEQ ID NO: 209490 - protein, 40 aa, Artificial Sequence
  Description of Artificial Sequence: Synthetic polypeptide
AEMEISTTNPVATEGYGQCAVCSNWEEDHNAEYFNSEFQS

SEQ ID NO: 209491 - protein, 39 aa, Artificial Sequence
  Description of Artificial Sequence: Synthetic polypeptide
AEMEISTTNPCAYEQYGQCVCSNSEEDDNAENFNSDTQS

SEQ ID NO: 209492 - protein, 39 aa, Artificial Sequence
  Description of Artificial Sequence: Synthetic polypeptide
AEMEISTTNPCATEGYGQCVCSNWGEDHNAENFNSETQN

SEQ ID NO: 209493 - protein, 37 aa, Artificial Sequence
  Description of Artificial Sequence: Synthetic polypeptide
AEMEIACTNPCSYEQYGCVCSWGEDHNQESFGSETQS

SEQ ID NO: 209494 - protein, 39 aa, Artificial Sequence
  Description of Artificial Sequence: Synthetic polypeptide
AEMEISCTNPVAYEQYGQCVCSNWMEDHNAENFNSDNQG

SEQ ID NO: 209495 - protein, 39 aa, Artificial Sequence
  Description of Artificial Sequence: Synthetic polypeptide
AEMEISCTNPVAYEQYGQCVCSNWGELHNAENFNSDNQG

SEQ ID NO: 209496 - protein, 38 aa, Artificial Sequence
  Description of Artificial Sequence: Synthetic polypeptide
NEMVIGTTNPVATEQYGCLCQATDGSPVEAFEHMDQKQ

SEQ ID NO: 209497 - protein, 39 aa, Artificial Sequence
  Description of Artificial Sequence: Synthetic polypeptide
AEMEISTTNPVAYEQYGQCVCSNWGEDHNAENFFSETQA

SEQ ID NO: 209498 - protein, 38 aa, Artificial Sequence
  Description of Artificial Sequence: Synthetic polypeptide
ADAEISTTNPVAYEQYGQCVCSNWGEHNIENFISDTQS

SEQ ID NO: 209499 - protein, 39 aa, Artificial Sequence
  Description of Artificial Sequence: Synthetic polypeptide
AEMCISTTNPVATEGYGQCVCSNWGEDHNTENFNSDTQP

SEQ ID NO: 209500 - protein, 39 aa, Artificial Sequence
  Description of Artificial Sequence: Synthetic polypeptide
ADAEISTTNPVATEQYGQCVCGNWGEDDNAENFISDTQA

SEQ ID NO: 209501 - protein, 38 aa, Artificial Sequence
  Description of Artificial Sequence: Synthetic polypeptide
DENCISTTNPVSTEGYGCICSNWEEDDNAEQFNSDTQA

SEQ ID NO: 209502 - protein, 38 aa, Artificial Sequence
  Description of Artificial Sequence: Synthetic polypeptide
DENCISTTNPVSTEGYGCICSNWEEDDNAEYFGSDTQS

SEQ ID NO: 209503 - protein, 39 aa, Artificial Sequence
  Description of Artificial Sequence: Synthetic polypeptide
DEAEISTTNPVAYEGYGQCVCGNWGEDDNIEYFNSENQA

SEQ ID NO: 209504 - protein, 37 aa, Artificial Sequence
  Description of Artificial Sequence: Synthetic polypeptide
DEEEIACTNPVAYAPWGPYACAAANGDAMQATNDQHQ

SEQ ID NO: 209505 - protein, 38 aa, Artificial Sequence
  Description of Artificial Sequence: Synthetic polypeptide
QEQEIATTNPVAYEQWGHCIIFAGNSGLVDNDSVNDAM

SEQ ID NO: 209506 - protein, 39 aa, Artificial Sequence
  Description of Artificial Sequence: Synthetic polypeptide
ADEAISTTNPVAYEGYGQCVCSTWGEDHNAEGFNSDTQN

SEQ ID NO: 209507 - protein, 37 aa, Artificial Sequence
  Description of Artificial Sequence: Synthetic polypeptide
DENCISTTNPVSTEGYGCICSNWEEDNAENFISDTQS

SEQ ID NO: 209508 - protein, 40 aa, Artificial Sequence
  Description of Artificial Sequence: Synthetic polypeptide
DENEIATTNPTCQLYYYEPYGSTVAVNSDGGQGGMNPAQM

SEQ ID NO: 209509 - protein, 38 aa, Artificial Sequence
  Description of Artificial Sequence: Synthetic polypeptide
DENCISTTNPVSTEGYGICICSNWEEDNAEQFNSDTQS

SEQ ID NO: 209510 - protein, 40 aa, Artificial Sequence
  Description of Artificial Sequence: Synthetic polypeptide
DEAEISTTNPVAYEGYGQCQVCSNWGYDHNTEGFISENQA

SEQ ID NO: 209511 - protein, 40 aa, Artificial Sequence
  Description of Artificial Sequence: Synthetic polypeptide
DEAEISTTNPVAYEGYGQCQVCSNWGEDHNAENSISDNQS

SEQ ID NO: 209512 - protein, 40 aa, Artificial Sequence
  Description of Artificial Sequence: Synthetic polypeptide
DEAEISTTNPVAYEGYGQCQVCSNWEEDHNAEYFNSDTQS

SEQ ID NO: 209513 - protein, 39 aa, Artificial Sequence
  Description of Artificial Sequence: Synthetic polypeptide
AENCISTTNPVAYEGYGQCVCSNWGEPDNTENFNSDNQS

SEQ ID NO: 209514 - protein, 36 aa, Artificial Sequence
  Description of Artificial Sequence: Synthetic polypeptide
DEGVACCTNPVAYAPWGSACSAANPAATENDQGTAM

SEQ ID NO: 209515 - protein, 39 aa, Artificial Sequence
  Description of Artificial Sequence: Synthetic polypeptide
ADAEISTTNPVATEGYGQCVCSNWGEDDNAEGFNSETQA

SEQ ID NO: 209516 - protein, 40 aa, Artificial Sequence
  Description of Artificial Sequence: Synthetic polypeptide
DEAEISTTNPVAYEGYGQCQVCSNWEEDHNAENFNSDNAA

SEQ ID NO: 209517 - protein, 39 aa, Artificial Sequence
  Description of Artificial Sequence: Synthetic polypeptide
DEAEISTTNPVAYEGYGQCVCGNWGEDHNAENFNSQFQS

SEQ ID NO: 209518 - protein, 39 aa, Artificial Sequence
  Description of Artificial Sequence: Synthetic polypeptide
AENCISTTNPVAYEGYGQCVCSTWGEDPNAENFNSDNQA

SEQ ID NO: 209519 - protein, 39 aa, Artificial Sequence
  Description of Artificial Sequence: Synthetic polypeptide
ADAEIRTTNPVAYEGYGQCVCSNWGEDHNAENFNSDNQP

SEQ ID NO: 209520 - protein, 39 aa, Artificial Sequence
  Description of Artificial Sequence: Synthetic polypeptide
DEAEISTTNPVAYEGYGQCVCSNWEEDHNAENFISDTQG

SEQ ID NO: 209521 - protein, 40 aa, Artificial Sequence
  Description of Artificial Sequence: Synthetic polypeptide
NEEEIATTNPVAYYEPQWGSPFAALAGPGGEPDANPPGHE

SEQ ID NO: 209522 - protein, 39 aa, Artificial Sequence
  Description of Artificial Sequence: Synthetic polypeptide
DERCISTTNPVAYEGYGQCVCSNWGEDHNIEYFNSDTQA

SEQ ID NO: 209523 - protein, 40 aa, Artificial Sequence
  Description of Artificial Sequence: Synthetic polypeptide
DENCISTTNPVAYEGYGQCQVCSNSGEDHNAENFGSDNQA

SEQ ID NO: 209524 - protein, 39 aa, Artificial Sequence
  Description of Artificial Sequence: Synthetic polypeptide
DEAEISTTNPVAYEGYGQCVCSNWEEDHNAENFISDTQA

SEQ ID NO: 209525 - protein, 39 aa, Artificial Sequence
  Description of Artificial Sequence: Synthetic polypeptide
AENCISTTNPVAYEQYGQCVCSNWGEEHNAENFNSDTQS

SEQ ID NO: 209526 - protein, 39 aa, Artificial Sequence
  Description of Artificial Sequence: Synthetic polypeptide
DENCISTTNPVAYEGYGQCVCSNWGEDHNAENFISDNQA

SEQ ID NO: 209527 - protein, 40 aa, Artificial Sequence
  Description of Artificial Sequence: Synthetic polypeptide
DENEIATTNPVATEQWGCTNNQANMNGVSTATAMIDEEWP

SEQ ID NO: 209528 - protein, 39 aa, Artificial Sequence
  Description of Artificial Sequence: Synthetic polypeptide
AENCISTTNPVAYEQYGQCVCSNWGEDDNAEYFNSDNQS

SEQ ID NO: 209529 - protein, 39 aa, Artificial Sequence
  Description of Artificial Sequence: Synthetic polypeptide
DEEEIATTNPVAYYAQWGGCTIFAGNNGDTATANQGGDA

SEQ ID NO: 209530 - protein, 39 aa, Artificial Sequence
  Description of Artificial Sequence: Synthetic polypeptide
DEAEISTTNPVAYEGYGQCVCSMWEEDHNIENFISDTQS

SEQ ID NO: 209531 - protein, 38 aa, Artificial Sequence
  Description of Artificial Sequence: Synthetic polypeptide
AEMAISTTNPVAYEGYGCVCSNWGEDHNAENFNSDTQN

SEQ ID NO: 209532 - protein, 39 aa, Artificial Sequence
  Description of Artificial Sequence: Synthetic polypeptide
DEMCISCTNPVATEGYGQCVCSNWEEDHNAENFNSETQA

SEQ ID NO: 209533 - protein, 39 aa, Artificial Sequence
  Description of Artificial Sequence: Synthetic polypeptide
DEAEISTTNPVAYEGYGQCVCGNWGEDHNIENFGSDTQS

SEQ ID NO: 209534 - protein, 39 aa, Artificial Sequence
  Description of Artificial Sequence: Synthetic polypeptide
ADAEISTTNPVATEGYGQCVCSMWGEDHNAENFNSDFQI

SEQ ID NO: 209535 - protein, 39 aa, Artificial Sequence
  Description of Artificial Sequence: Synthetic polypeptide
DERCISTTNPVAYEGYGQCVCSNWPEDHNAENFNSDTQS

SEQ ID NO: 209536 - protein, 40 aa, Artificial Sequence
  Description of Artificial Sequence: Synthetic polypeptide
DENEIATTNPTCQLYYQDPYGSTVAVNSDGGQGGMNPAGE

SEQ ID NO: 209537 - protein, 39 aa, Artificial Sequence
  Description of Artificial Sequence: Synthetic polypeptide
DEAEISTTNPVAYEGYGQCQVCSNSGEHNEENFPSDTQL

SEQ ID NO: 209538 - protein, 38 aa, Artificial Sequence
  Description of Artificial Sequence: Synthetic polypeptide
ADEAISTTNPCAYEQYGCVCSNWGEDHNAENFNSDNQA

SEQ ID NO: 209539 - protein, 38 aa, Artificial Sequence
  Description of Artificial Sequence: Synthetic polypeptide
ADEAISTTNPCATEQYGQCVCGWGEDDNAENFNSDTQA

SEQ ID NO: 209540 - protein, 39 aa, Artificial Sequence
  Description of Artificial Sequence: Synthetic polypeptide
AEMEISTTNPVAYEQYGQCVCSNWGEDPNAEFFSSDTQA

SEQ ID NO: 209541 - protein, 39 aa, Artificial Sequence
  Description of Artificial Sequence: Synthetic polypeptide
DENAISCTNPVATEGYGQCVCSNWGEDPNAEYFNSDNQS

SEQ ID NO: 209542 - protein, 39 aa, Artificial Sequence
  Description of Artificial Sequence: Synthetic polypeptide
DEAEISTTNPVAYEGYGQCQVCPNWGEHNAENFNSQFQS

SEQ ID NO: 209543 - protein, 36 aa, Artificial Sequence
  Description of Artificial Sequence: Synthetic polypeptide
QENEIATTNPVAYEPWGPNTIAGEGLQQNHMEMQLN

SEQ ID NO: 209544 - protein, 39 aa, Artificial Sequence
  Description of Artificial Sequence: Synthetic polypeptide
AEMCISTTNPVATEGYGQCVCSNWEEDHNIENFNSDPQA

SEQ ID NO: 209545 - protein, 40 aa, Artificial Sequence
  Description of Artificial Sequence: Synthetic polypeptide
DEEEIKTNNPHATGQWYATYKPPETVNTLSECRNGCTEDS

SEQ ID NO: 209546 - protein, 39 aa, Artificial Sequence
  Description of Artificial Sequence: Synthetic polypeptide
DEMCISCTNPVATEQYGQCVCGMWEEDHNAESFNSDNQS

SEQ ID NO: 209547 - protein, 39 aa, Artificial Sequence
  Description of Artificial Sequence: Synthetic polypeptide
DENAISTTNPVATEGYGQCVCSNWGEDHNTEGFISDTQS

SEQ ID NO: 209548 - protein, 39 aa, Artificial Sequence
  Description of Artificial Sequence: Synthetic polypeptide
DEGEVHRTYNPHATAKQMCGENAECETHNCGLGRGMMYF

SEQ ID NO: 209549 - protein, 39 aa, Artificial Sequence
  Description of Artificial Sequence: Synthetic polypeptide
DEMCISCTNPVATEQYGQCVCGNWGEDDNAENFNSENQS

SEQ ID NO: 209550 - protein, 39 aa, Artificial Sequence
  Description of Artificial Sequence: Synthetic polypeptide
AEMCISTTNPVATEGYGQCVCSNWGEDHNAENFNSDTQN

SEQ ID NO: 209551 - protein, 39 aa, Artificial Sequence
  Description of Artificial Sequence: Synthetic polypeptide
AEMCISTTNPVATEGYGQCVCSNWGEDHNAENFNSQNQL

SEQ ID NO: 209552 - protein, 39 aa, Artificial Sequence
  Description of Artificial Sequence: Synthetic polypeptide
ADEAIRTTNPCATEGYGQCVCSNWGEDHNAENFNSDNQA

SEQ ID NO: 209553 - protein, 39 aa, Artificial Sequence
  Description of Artificial Sequence: Synthetic polypeptide
AEMEISTVNPVATEGYGQCVCSNWGEDHNAENFNSDTQS

SEQ ID NO: 209554 - protein, 36 aa, Artificial Sequence
  Description of Artificial Sequence: Synthetic polypeptide
DEGVACCTNPVAYAPWGRSACSAANPATENDQGTDM

SEQ ID NO: 209555 - protein, 39 aa, Artificial Sequence
  Description of Artificial Sequence: Synthetic polypeptide
AENAISTTNPVATEGYGQCVCSNSGEDHNAEHFNSDNQS

SEQ ID NO: 209556 - protein, 38 aa, Artificial Sequence
  Description of Artificial Sequence: Synthetic polypeptide
AENAISTTNPVAYEGYGQCVCSNSGEHNAENFISDNQA

SEQ ID NO: 209557 - protein, 40 aa, Artificial Sequence
  Description of Artificial Sequence: Synthetic polypeptide
DEAEISTTNPVAYEGYGQCQVCSNSGEDHNAENFNSDTQA

SEQ ID NO: 209558 - protein, 39 aa, Artificial Sequence
  Description of Artificial Sequence: Synthetic polypeptide
DEMCISTTNPVATEGYGQCICSNWGEDHNTEGFNSDTQS

SEQ ID NO: 209559 - protein, 37 aa, Artificial Sequence
  Description of Artificial Sequence: Synthetic polypeptide
DENEIATTNPTAYECWGATTSANATDGPAEPKGGPYN

SEQ ID NO: 209560 - protein, 39 aa, Artificial Sequence
  Description of Artificial Sequence: Synthetic polypeptide
AENCIRTTNPVATEQWGQCVCSNSGEDENAENSSSDTAA

SEQ ID NO: 209561 - protein, 39 aa, Artificial Sequence
  Description of Artificial Sequence: Synthetic polypeptide
AENCIRTTNPCATEGYGQCVCSNWGEDHNAENFNSDNQS

SEQ ID NO: 209562 - protein, 40 aa, Artificial Sequence
  Description of Artificial Sequence: Synthetic polypeptide
QEEEIATTNPVATEQWGCTNNQANGNGVDTATANIDEEAP

SEQ ID NO: 209563 - protein, 39 aa, Artificial Sequence
  Description of Artificial Sequence: Synthetic polypeptide
CEEEIACTNPVATEQWGGCCTAAAGNHYNPATMHHNTQG

SEQ ID NO: 209564 - protein, 38 aa, Artificial Sequence
  Description of Artificial Sequence: Synthetic polypeptide
AENCIATTNPVATEGYGQCVCSNWMEDNAEHFISETQS

SEQ ID NO: 209565 - protein, 39 aa, Artificial Sequence
  Description of Artificial Sequence: Synthetic polypeptide
CEEEIACTNPVATEQWGGCCNAIIGAHTGNIPDQDEETH

SEQ ID NO: 209566 - protein, 39 aa, Artificial Sequence
  Description of Artificial Sequence: Synthetic polypeptide
DENEIATTNPIATECWGATYYANENDHQLHEKTGQKGMS

SEQ ID NO: 209567 - protein, 38 aa, Artificial Sequence
  Description of Artificial Sequence: Synthetic polypeptide
AENCIATTNPVATEGYGCVCSNWGEDDNAEHFISETQA

SEQ ID NO: 209568 - protein, 37 aa, Artificial Sequence
  Description of Artificial Sequence: Synthetic polypeptide
DENEIATTNPCMLYYEPYGTTSAMEWDQAEQNGDTHK

SEQ ID NO: 209569 - protein, 40 aa, Artificial Sequence
  Description of Artificial Sequence: Synthetic polypeptide
DEAEISTTNPVAYEGYGQCQVCPTSGEDPNAENFNSDTQA

SEQ ID NO: 209570 - protein, 38 aa, Artificial Sequence
  Description of Artificial Sequence: Synthetic polypeptide
DENEIATTNPCITYEPYGTPTPSAMEWDQAQQNGTVHW

SEQ ID NO: 209571 - protein, 39 aa, Artificial Sequence
  Description of Artificial Sequence: Synthetic polypeptide
ADEAISTTNPVATEQYGQCVCSMWGEDHNAENFISDTQA

SEQ ID NO: 209572 - protein, 38 aa, Artificial Sequence
  Description of Artificial Sequence: Synthetic polypeptide
SEEEIATTNPVAYAPWGHSASAAGGPLDTDAGQGQDEH

SEQ ID NO: 209573 - protein, 39 aa, Artificial Sequence
  Description of Artificial Sequence: Synthetic polypeptide
AEMCISTTNPVAYEQYGQCVCSNWMEDHNAENFNSDFQP

SEQ ID NO: 209574 - protein, 39 aa, Artificial Sequence
  Description of Artificial Sequence: Synthetic polypeptide
SEECISCTNPVAYEQYGQCVCSNWGEDHNAEYFNSDNQG

SEQ ID NO: 209575 - protein, 40 aa, Artificial Sequence
  Description of Artificial Sequence: Synthetic polypeptide
AEAEISTTNPVAYEYYGQCQSCSNWGADHNTENFNSDNQP

SEQ ID NO: 209576 - protein, 39 aa, Artificial Sequence
  Description of Artificial Sequence: Synthetic polypeptide
AEACISTTNPVATEGYGQCVCSNWGEGHNAENFNSDNAA

SEQ ID NO: 209577 - protein, 39 aa, Artificial Sequence
  Description of Artificial Sequence: Synthetic polypeptide
AEACISTTNPVATEQWGQCVCSNWGEDDNAENFNSDTQS

SEQ ID NO: 209578 - protein, 39 aa, Artificial Sequence
  Description of Artificial Sequence: Synthetic polypeptide
AEACISTTNPVATEQWGQCVCSNWGEDHNAENFNSDNQA

SEQ ID NO: 209579 - protein, 39 aa, Artificial Sequence
  Description of Artificial Sequence: Synthetic polypeptide
DEECISTTNPVAYEGWGQCVCSNWGEDHNAEGFNSDNQM

SEQ ID NO: 209580 - protein, 40 aa, Artificial Sequence
  Description of Artificial Sequence: Synthetic polypeptide
AEACISTTNPVATEQYGQCQVCSNWGYDHNTEGFNSENQA

SEQ ID NO: 209581 - protein, 39 aa, Artificial Sequence
  Description of Artificial Sequence: Synthetic polypeptide
AEACISTTNPVATEQYGQCVCGNWGEDHNAEYFNSEPQM

SEQ ID NO: 209582 - protein, 39 aa, Artificial Sequence
  Description of Artificial Sequence: Synthetic polypeptide
AEACISTTNPVATEQYGQCVCGNWMEDHNAENFISETQA

SEQ ID NO: 209583 - protein, 39 aa, Artificial Sequence
  Description of Artificial Sequence: Synthetic polypeptide
AEACISTTNPVATEQYGQCVCQNWGEDHNAEYSNSEFQA

SEQ ID NO: 209584 - protein, 38 aa, Artificial Sequence
  Description of Artificial Sequence: Synthetic polypeptide
SEACISCTNPVATEGYGQCVCSNWGEHNTENFNSDTQF

SEQ ID NO: 209585 - protein, 39 aa, Artificial Sequence
  Description of Artificial Sequence: Synthetic polypeptide
AEACISTTNPVATEQYGQCVCSNWGEDHNAENFISDTQA

SEQ ID NO: 209586 - protein, 39 aa, Artificial Sequence
  Description of Artificial Sequence: Synthetic polypeptide
SEACISCTNPVATEQYGQCVCQNSGEDDNAEHFNSDTQS

SEQ ID NO: 209587 - protein, 39 aa, Artificial Sequence
  Description of Artificial Sequence: Synthetic polypeptide
SEACISCTNPVATEQYGQCVCSNWGEDHNTENFISDTQF

SEQ ID NO: 209588 - protein, 39 aa, Artificial Sequence
  Description of Artificial Sequence: Synthetic polypeptide
AEACISTTNPVAYEGYGICVCSNWGEPHNTENFNSDNQA

SEQ ID NO: 209589 - protein, 39 aa, Artificial Sequence
  Description of Artificial Sequence: Synthetic polypeptide
DEECISTTNPVAYEGWGQCVCSNWGEDHNAENSNSDTQA

SEQ ID NO: 209590 - protein, 39 aa, Artificial Sequence
  Description of Artificial Sequence: Synthetic polypeptide
AEACISTTNPVAYEGYGQCVCSNSGEDHNAENFGSDNQA

SEQ ID NO: 209591 - protein, 39 aa, Artificial Sequence
  Description of Artificial Sequence: Synthetic polypeptide
AEACISTTNPVAYEGYGQCVCSNSMEDHNTENFISDNQA

SEQ ID NO: 209592 - protein, 39 aa, Artificial Sequence
  Description of Artificial Sequence: Synthetic polypeptide
AEACISTTNPVAYEGYGQCVCSNWGEGHNAENFGSDNQS

SEQ ID NO: 209593 - protein, 38 aa, Artificial Sequence
  Description of Artificial Sequence: Synthetic polypeptide
AEACISTTNPVAYEGYGQCVCSNWGEHNAENFNSDTQA

SEQ ID NO: 209594 - protein, 38 aa, Artificial Sequence
  Description of Artificial Sequence: Synthetic polypeptide
AEACISTTNPVAYEGYGQCVCSNWGEHNAENFNSDTQN

SEQ ID NO: 209595 - protein, 39 aa, Artificial Sequence
  Description of Artificial Sequence: Synthetic polypeptide
AEACISTTNPVAYEGYGQCVCSTWGEDHNAENFQSDTQP

SEQ ID NO: 209596 - protein, 38 aa, Artificial Sequence
  Description of Artificial Sequence: Synthetic polypeptide
AEACISTTNPVAYEQYGCVCGNWGEDHNIEYFNSETQA

SEQ ID NO: 209597 - protein, 39 aa, Artificial Sequence
  Description of Artificial Sequence: Synthetic polypeptide
AEACISTTNPVATEGYGQCVCSNWGEDHNTENFNSDTQF

SEQ ID NO: 209598 - protein, 39 aa, Artificial Sequence
  Description of Artificial Sequence: Synthetic polypeptide
AEACISTTNPVATEGYGQCVCSNWGEDHNAEYFNSDTQA

SEQ ID NO: 209599 - protein, 39 aa, Artificial Sequence
  Description of Artificial Sequence: Synthetic polypeptide
AEACISTTNPVATEGYGQCVCSNWGEDHNAEYFISENQS

SEQ ID NO: 209600 - protein, 39 aa, Artificial Sequence
  Description of Artificial Sequence: Synthetic polypeptide
AEACISTTNPVATEGYGQCVCSNWGEDHNAENFPSDNQM

SEQ ID NO: 209601 - protein, 38 aa, Artificial Sequence
  Description of Artificial Sequence: Synthetic polypeptide
AEAAISTTNPVAYEGYGQCVCSWGEDHNAEGFNSDTQS

SEQ ID NO: 209602 - protein, 39 aa, Artificial Sequence
  Description of Artificial Sequence: Synthetic polypeptide
AEAAISTTNPVAYEQYGQCVCSNWGEDHNAEGFDSDNQL

SEQ ID NO: 209603 - protein, 39 aa, Artificial Sequence
  Description of Artificial Sequence: Synthetic polypeptide
SEAAISTTNPVAYEAYGQCVCSNWGEDHNTENFSSDNAS

SEQ ID NO: 209604 - protein, 39 aa, Artificial Sequence
  Description of Artificial Sequence: Synthetic polypeptide
AEAAISTTNPVAYEYYGCQSCSNWGADHNTENFISDNQP

SEQ ID NO: 209605 - protein, 39 aa, Artificial Sequence
  Description of Artificial Sequence: Synthetic polypeptide
SEAAISTTNPVAYEGYGQCVCSTWGEDHNTENFISDNAS

SEQ ID NO: 209606 - protein, 39 aa, Artificial Sequence
  Description of Artificial Sequence: Synthetic polypeptide
SEAAISTTNPVAYEQYGQCVCQNWGEDPNAEGFNSDNQA

SEQ ID NO: 209607 - protein, 39 aa, Artificial Sequence
  Description of Artificial Sequence: Synthetic polypeptide
SEAAISTTNPVAYEQYGQCVCSNWGELDNAENFNSDTQS

SEQ ID NO: 209608 - protein, 39 aa, Artificial Sequence
  Description of Artificial Sequence: Synthetic polypeptide
AEACIATTNPVAYEQYGQCVCSMWEEDHNAENFNSDTQA

SEQ ID NO: 209609 - protein, 39 aa, Artificial Sequence
  Description of Artificial Sequence: Synthetic polypeptide
AEACIGTTNPVAYEGYGQCVCSNWGEDHNTENFNSDNAA

SEQ ID NO: 209610 - protein, 39 aa, Artificial Sequence
  Description of Artificial Sequence: Synthetic polypeptide
SEAAISTTNPVAYEQYGQCVCSNWMEDHNAEGFNSDNQF

SEQ ID NO: 209611 - protein, 39 aa, Artificial Sequence
  Description of Artificial Sequence: Synthetic polypeptide
AEACISTTNPVAYEQYGQCVCGTWGEDDNAENFISDNQA

SEQ ID NO: 209612 - protein, 39 aa, Artificial Sequence
  Description of Artificial Sequence: Synthetic polypeptide
SEAAISTTNPVAYEQYGQCYCSNSGEDDNAENFNSDTQS

SEQ ID NO: 209613 - protein, 41 aa, Artificial Sequence
  Description of Artificial Sequence: Synthetic polypeptide
FEETIRTTNPCATDQVYVIRVVESLDPTSEQQFLTGMVFRF

SEQ ID NO: 209614 - protein, 39 aa, Artificial Sequence
  Description of Artificial Sequence: Synthetic polypeptide
AEACISCTNPVATEQYGQCVCSNWEEDTNIENFISDTQA

SEQ ID NO: 209615 - protein, 38 aa, Artificial Sequence
  Description of Artificial Sequence: Synthetic polypeptide
AEACISCTNPVAYEQYGCVCSMWEEDHNAENFNSDTQA

SEQ ID NO: 209616 - protein, 39 aa, Artificial Sequence
  Description of Artificial Sequence: Synthetic polypeptide
AEACISCTNPVAYEQYGQCSCSNWGEDTNIEHFISVNQA

SEQ ID NO: 209617 - protein, 39 aa, Artificial Sequence
  Description of Artificial Sequence: Synthetic polypeptide
AEACISCTNPVAYEQYGQCVCSNWMEAHNTENFISDNQA

SEQ ID NO: 209618 - protein, 38 aa, Artificial Sequence
  Description of Artificial Sequence: Synthetic polypeptide
AEACISTTNPCAYEQYGQCVCQNSGYHNAENFNSDTQA

SEQ ID NO: 209619 - protein, 39 aa, Artificial Sequence
  Description of Artificial Sequence: Synthetic polypeptide
AEACISTTNPVATEEYGQCVCSNSGEDHNAESFNSDTAA

SEQ ID NO: 209620 - protein, 38 aa, Artificial Sequence
  Description of Artificial Sequence: Synthetic polypeptide
AEACISTTNPVATEGYGQCVCGNSGEHNAENFISDTQS

SEQ ID NO: 209621 - protein, 39 aa, Artificial Sequence
  Description of Artificial Sequence: Synthetic polypeptide
AEACISTTNPVATEGYGQCVCSNWGADHNAENFNSDTQP

SEQ ID NO: 209622 - protein, 39 aa, Artificial Sequence
  Description of Artificial Sequence: Synthetic polypeptide
AEACISTTNPVATEGYGQCVCSNWGEDHNAENFISENQI

SEQ ID NO: 209623 - protein, 39 aa, Artificial Sequence
  Description of Artificial Sequence: Synthetic polypeptide
AEACIRTTNPVAYEQYGQCVCYNWGEDHNTENFNSETQL

SEQ ID NO: 209624 - protein, 38 aa, Artificial Sequence
  Description of Artificial Sequence: Synthetic polypeptide
AEAAISTTNPVAYEGYGCVCSNWGEDHNAEGSNSDNQS

SEQ ID NO: 209625 - protein, 39 aa, Artificial Sequence
  Description of Artificial Sequence: Synthetic polypeptide
AEACISTTNPVAYEQYGQCVCSNWEEDHNAENFQSDTQS

SEQ ID NO: 209626 - protein, 39 aa, Artificial Sequence
  Description of Artificial Sequence: Synthetic polypeptide
AEACISTTNPVAYEQYGQCVCSNWGEAHNAENFNSDTQS

SEQ ID NO: 209627 - protein, 40 aa, Artificial Sequence
  Description of Artificial Sequence: Synthetic polypeptide
DEECISTTNPVAYEGYGQCQVCSNWGYDHNTEGFISENQS

SEQ ID NO: 209628 - protein, 38 aa, Artificial Sequence
  Description of Artificial Sequence: Synthetic polypeptide
CEEEIACTNPVAYEQWGCNFPATGGELADIDNSDESAM

SEQ ID NO: 209629 - protein, 39 aa, Artificial Sequence
  Description of Artificial Sequence: Synthetic polypeptide
CEEEIACTNPVAYEQWGCNTVTAGDGHGEMTADGNGDRF

SEQ ID NO: 209630 - protein, 40 aa, Artificial Sequence
  Description of Artificial Sequence: Synthetic polypeptide
FQEAEIRATTNPAATGRWYYGSSCIYSTHIDEGTYNYDEG

SEQ ID NO: 209631 - protein, 39 aa, Artificial Sequence
  Description of Artificial Sequence: Synthetic polypeptide
SEACISTTNPVAYEGYGQCVCSNWMELHNTENFISDNQA

SEQ ID NO: 209632 - protein, 39 aa, Artificial Sequence
  Description of Artificial Sequence: Synthetic polypeptide
DEMCIRTTNPCATEGWGQCQTCQNSEEDNAENSGSDNQA

SEQ ID NO: 209633 - protein, 39 aa, Artificial Sequence
  Description of Artificial Sequence: Synthetic polypeptide
SEACISTTNPVAYEQYGQCVCGNWEEGHNAENFQSDNQP

SEQ ID NO: 209634 - protein, 38 aa, Artificial Sequence
  Description of Artificial Sequence: Synthetic polypeptide
CEEEIACTNPVAYEQWGHCFVANAGEHADIGNSDESAM

SEQ ID NO: 209635 - protein, 39 aa, Artificial Sequence
  Description of Artificial Sequence: Synthetic polypeptide
SEACISTTNPVAYEQYGQCVCSNWGEDDNAENFNSDTQA

SEQ ID NO: 209636 - protein, 39 aa, Artificial Sequence
  Description of Artificial Sequence: Synthetic polypeptide
SEACISTTNPVAYEQYGQCVCSNWGEDHNAENFISDNQG

SEQ ID NO: 209637 - protein, 38 aa, Artificial Sequence
  Description of Artificial Sequence: Synthetic polypeptide
AEAEIACTNPVGTEGYGQCSCGSGEDHNAEHFGSDTQS

SEQ ID NO: 209638 - protein, 39 aa, Artificial Sequence
  Description of Artificial Sequence: Synthetic polypeptide
SEACISTTNPVAYEQYGQCVCSNWGEDHNAENSISDNQS

SEQ ID NO: 209639 - protein, 37 aa, Artificial Sequence
  Description of Artificial Sequence: Synthetic polypeptide
AEAEIACTNPVGTEGYGVSCGNWGEHNAEHFGSDTQS

SEQ ID NO: 209640 - protein, 39 aa, Artificial Sequence
  Description of Artificial Sequence: Synthetic polypeptide
ADEEISTTNPVATEGYGQCVCGNWGEDDNAENFNSDTQI

SEQ ID NO: 209641 - protein, 39 aa, Artificial Sequence
  Description of Artificial Sequence: Synthetic polypeptide
DDECISTTNPVAYEEYGQCVCSNWEEDDNAENFNSDTQA

SEQ ID NO: 209642 - protein, 39 aa, Artificial Sequence
  Description of Artificial Sequence: Synthetic polypeptide
DDECISTTNPVAYEEYGQCVCSNSMEDHNAEHFNSDNQF

SEQ ID NO: 209643 - protein, 39 aa, Artificial Sequence
  Description of Artificial Sequence: Synthetic polypeptide
DDECISTTNPVAYCQYGQCVCSNWGEGHNAENFNSDTQS

SEQ ID NO: 209644 - protein, 40 aa, Artificial Sequence
  Description of Artificial Sequence: Synthetic polypeptide
ADEEISTTNPVATEGYGQCAVCSNWGEPHNAENFNSETQS

SEQ ID NO: 209645 - protein, 39 aa, Artificial Sequence
  Description of Artificial Sequence: Synthetic polypeptide
DEECISTTNPVAYEGYGQCVCGNWGEAHNAENFISETQS

SEQ ID NO: 209646 - protein, 38 aa, Artificial Sequence
  Description of Artificial Sequence: Synthetic polypeptide
DEGEIACTNPVATEQWGCIIWAPLNNDHENTADNGMDS

SEQ ID NO: 209647 - protein, 39 aa, Artificial Sequence
  Description of Artificial Sequence: Synthetic polypeptide
DEECISTTNPVAYEGYGQCVCGNWGEDHNAEFFISDTQP

SEQ ID NO: 209648 - protein, 38 aa, Artificial Sequence
  Description of Artificial Sequence: Synthetic polypeptide
SEACISTTNPVAYEGYGQCVCSNWGEHNAESFNSDNQS

SEQ ID NO: 209649 - protein, 38 aa, Artificial Sequence
  Description of Artificial Sequence: Synthetic polypeptide
CEEEIACTNPVAYEQWGCFPAATGGEPADIGNSDESAM

SEQ ID NO: 209650 - protein, 39 aa, Artificial Sequence
  Description of Artificial Sequence: Synthetic polypeptide
SEACISTTNPVAYEGYGCASCSNWGEDHNAEHFQSDNQL

SEQ ID NO: 209651 - protein, 39 aa, Artificial Sequence
  Description of Artificial Sequence: Synthetic polypeptide
DEMCIRCTNPVAYEGYGQCVCSNWGEDHNAENFNSENQL

SEQ ID NO: 209652 - protein, 39 aa, Artificial Sequence
  Description of Artificial Sequence: Synthetic polypeptide
AEACISTTNPVAYEQYGQCVCSNWGEDDNAENFNSDNQG

SEQ ID NO: 209653 - protein, 39 aa, Artificial Sequence
  Description of Artificial Sequence: Synthetic polypeptide
AEACISTTNPVAYEQYGQCVCSNWGEDHNAENFQSDTQA

SEQ ID NO: 209654 - protein, 39 aa, Artificial Sequence
  Description of Artificial Sequence: Synthetic polypeptide
AEACISTTNPVAYEQYGQCVCSNWGEDHNAEYFNSDTQN

SEQ ID NO: 209655 - protein, 38 aa, Artificial Sequence
  Description of Artificial Sequence: Synthetic polypeptide
SEACISCTNPVAYEQYGCVCSNWGEDHNTENFNSDTQN

SEQ ID NO: 209656 - protein, 39 aa, Artificial Sequence
  Description of Artificial Sequence: Synthetic polypeptide
AEACISTTNPVAYEQYGQCVCSNWVEDHNAEGFNSDTQS

SEQ ID NO: 209657 - protein, 40 aa, Artificial Sequence
  Description of Artificial Sequence: Synthetic polypeptide
DEECISTTNPVAYEGYGQCAVCSDWEEDHNAENFNSQTQI

SEQ ID NO: 209658 - protein, 39 aa, Artificial Sequence
  Description of Artificial Sequence: Synthetic polypeptide
AEACISTTNPVAYEQYGQCVCSTWGEDHNTENFISDTQP

SEQ ID NO: 209659 - protein, 39 aa, Artificial Sequence
  Description of Artificial Sequence: Synthetic polypeptide
SEACISTTNPVATEEYGQCVCSNWGEDDNTENFNSDTQA

SEQ ID NO: 209660 - protein, 40 aa, Artificial Sequence
  Description of Artificial Sequence: Synthetic polypeptide
DEECISTTNPVAYEGYGQCAVCSNWGEDHNTENFGSETQF

SEQ ID NO: 209661 - protein, 40 aa, Artificial Sequence
  Description of Artificial Sequence: Synthetic polypeptide
SEACISTTNPVATEGYGQCAVCSTWGEDHNAEYFNSDTQA

SEQ ID NO: 209662 - protein, 39 aa, Artificial Sequence
  Description of Artificial Sequence: Synthetic polypeptide
AEACISTTNPVAYEQYGQCVCSNWEEDHNIENFNSDPQA

SEQ ID NO: 209663 - protein, 39 aa, Artificial Sequence
  Description of Artificial Sequence: Synthetic polypeptide
SEACISTTNPVATEGYGQCVCSNSGEDHNAENFNSDNQA

SEQ ID NO: 209664 - protein, 39 aa, Artificial Sequence
  Description of Artificial Sequence: Synthetic polypeptide
SEACISTTNPVATEGYGQCVCSNWGEDHNAEFFNSDTQM

SEQ ID NO: 209665 - protein, 39 aa, Artificial Sequence
  Description of Artificial Sequence: Synthetic polypeptide
SEACISTTNPVATEGYGQCVCSNWGEDHNAEGFNSDTQS

SEQ ID NO: 209666 - protein, 39 aa, Artificial Sequence
  Description of Artificial Sequence: Synthetic polypeptide
SEACISTTNPVATEGYGQCVCSNWGEGHNAENFNSDNQS

SEQ ID NO: 209667 - protein, 40 aa, Artificial Sequence
  Description of Artificial Sequence: Synthetic polypeptide
DEECISTTNPVAYEGYGQCIVCSNWGEAHNTENFNSETQS

SEQ ID NO: 209668 - protein, 39 aa, Artificial Sequence
  Description of Artificial Sequence: Synthetic polypeptide
SEACISTTNPVATEGYGQCVCSNWMEDHNAENFNSDFQP

SEQ ID NO: 209669 - protein, 39 aa, Artificial Sequence
  Description of Artificial Sequence: Synthetic polypeptide
SEACISTTNPVATEQYGQCVCGNWGEDHNIEYFNSDTQG

SEQ ID NO: 209670 - protein, 40 aa, Artificial Sequence
  Description of Artificial Sequence: Synthetic polypeptide
DEECISTTNPVAYEGYGQCQVCQNSGEDDNTENFSSETQA

SEQ ID NO: 209671 - protein, 37 aa, Artificial Sequence
  Description of Artificial Sequence: Synthetic polypeptide
QEENVIRGTTEEIVNETPQQYNGYEADQPQTGRGIHE

SEQ ID NO: 209672 - protein, 39 aa, Artificial Sequence
  Description of Artificial Sequence: Synthetic polypeptide
SEACISTTNPVATEQYGQCVCSMSGEDHNAENFISETQA

SEQ ID NO: 209673 - protein, 38 aa, Artificial Sequence
  Description of Artificial Sequence: Synthetic polypeptide
FEWDEWRTCTNPWVATMNYKGRVSTAKVGESDFDIQQH

SEQ ID NO: 209674 - protein, 40 aa, Artificial Sequence
  Description of Artificial Sequence: Synthetic polypeptide
DEECISTTNPVAYEGYGQCAVCSTWGEDHNAENFISDTQA

SEQ ID NO: 209675 - protein, 39 aa, Artificial Sequence
  Description of Artificial Sequence: Synthetic polypeptide
AEAAISTTNPVATEQYGQCVCSNWGEDHNAENFPSDTQS

SEQ ID NO: 209676 - protein, 39 aa, Artificial Sequence
  Description of Artificial Sequence: Synthetic polypeptide
SEAAIGTTNPVAYEQYGQCVCGNWGEDHNTENFNSDNAS

SEQ ID NO: 209677 - protein, 39 aa, Artificial Sequence
  Description of Artificial Sequence: Synthetic polypeptide
AEAAISTTNPVATEGYGQCVCSNWGEDPNAEYFNSDNQS

SEQ ID NO: 209678 - protein, 38 aa, Artificial Sequence
  Description of Artificial Sequence: Synthetic polypeptide
SDACISTTNPVAYEEYGCVCSNWGEGTNAENFNSETQS

SEQ ID NO: 209679 - protein, 39 aa, Artificial Sequence
  Description of Artificial Sequence: Synthetic polypeptide
SDAEIRTTNPVAYEGYGQCVCSMWGEDHNAENFNSQTQS

SEQ ID NO: 209680 - protein, 39 aa, Artificial Sequence
  Description of Artificial Sequence: Synthetic polypeptide
ADMEIRTTNPVAYEGYGQCVCSNWGEDHNAENFNSDTQG

SEQ ID NO: 209681 - protein, 39 aa, Artificial Sequence
  Description of Artificial Sequence: Synthetic polypeptide
SDAEISTTNPVATEGYGQCVCGNSGEDHNAENFGSDTQS

SEQ ID NO: 209682 - protein, 39 aa, Artificial Sequence
  Description of Artificial Sequence: Synthetic polypeptide
SDAEISTTNPVATEGYGQCVCQNWGEDDNQENFNSDTQQ

SEQ ID NO: 209683 - protein, 39 aa, Artificial Sequence
  Description of Artificial Sequence: Synthetic polypeptide
SDAEISTTNPVATEGYGQCVCSNWGEDDNIENFNSDTQI

SEQ ID NO: 209684 - protein, 39 aa, Artificial Sequence
  Description of Artificial Sequence: Synthetic polypeptide
SDAEISTTNPVATEGYGQCVCSNWMEDHNAEHFNSETQF

SEQ ID NO: 209685 - protein, 39 aa, Artificial Sequence
  Description of Artificial Sequence: Synthetic polypeptide
SDAEISTTNPVATEQYGQCVCSNWEEDHNAENFISDTQN

SEQ ID NO: 209686 - protein, 39 aa, Artificial Sequence
  Description of Artificial Sequence: Synthetic polypeptide
AEEEISCTNPVAYEQYGQCVCYNWGEDHNTENFNSETQL

SEQ ID NO: 209687 - protein, 39 aa, Artificial Sequence
  Description of Artificial Sequence: Synthetic polypeptide
ADMEISTTNPVAYEQYGQCVCSNSGEDDNAENFNSDFQM

SEQ ID NO: 209688 - protein, 39 aa, Artificial Sequence
  Description of Artificial Sequence: Synthetic polypeptide
AEEEISCTNPVAYEQYGQCVCSNWGEDHNAENFISETQA

SEQ ID NO: 209689 - protein, 39 aa, Artificial Sequence
  Description of Artificial Sequence: Synthetic polypeptide
ADMEISTTNPVAYEQYGQCVCSNWEEDTNIENFISDTQA

SEQ ID NO: 209690 - protein, 39 aa, Artificial Sequence
  Description of Artificial Sequence: Synthetic polypeptide
AEEEISCTNPVAYEQYGQCVCSNSGEDHNAENFFSDTQP

SEQ ID NO: 209691 - protein, 39 aa, Artificial Sequence
  Description of Artificial Sequence: Synthetic polypeptide
ADMEISTTNPVAYEQYGQCVCSNWEEPHNIEHFNSDTQG

SEQ ID NO: 209692 - protein, 39 aa, Artificial Sequence
  Description of Artificial Sequence: Synthetic polypeptide
SDAEISTTNPVAYEGYGQCVCSTWGEDPNAEHFNSETQS

SEQ ID NO: 209693 - protein, 39 aa, Artificial Sequence
  Description of Artificial Sequence: Synthetic polypeptide
SDAEISTTNPVAYEQYGQCVCSMSGEDHNAENFQSDTQA

SEQ ID NO: 209694 - protein, 39 aa, Artificial Sequence
  Description of Artificial Sequence: Synthetic polypeptide
ADMEISTTNPVAYEQYGQCVCSNWGEAHNAENSNSDTQS

SEQ ID NO: 209695 - protein, 39 aa, Artificial Sequence
  Description of Artificial Sequence: Synthetic polypeptide
ADMEISTTNPVAYEQYGQCVCSNWGEDHNAEHFNSDTQP

SEQ ID NO: 209696 - protein, 39 aa, Artificial Sequence
  Description of Artificial Sequence: Synthetic polypeptide
AEEEISCTNPVAYEGYGQCVCSNWGEGHNAENFNSDNAA

SEQ ID NO: 209697 - protein, 39 aa, Artificial Sequence
  Description of Artificial Sequence: Synthetic polypeptide
SDAEISTTNPVAYEQYGQCVCSNWGEDHNAEHFISDNQG

SEQ ID NO: 209698 - protein, 39 aa, Artificial Sequence
  Description of Artificial Sequence: Synthetic polypeptide
SDAEISTTNPVAYEQYGQCVTSNWGEDHNAENFNSDNQS

SEQ ID NO: 209699 - protein, 39 aa, Artificial Sequence
  Description of Artificial Sequence: Synthetic polypeptide
SDACISTTNPVATEQYGQCVCSNWGEDHNQENFNSDTQA

SEQ ID NO: 209700 - protein, 38 aa, Artificial Sequence
  Description of Artificial Sequence: Synthetic polypeptide
SDACISTTNPVATEGYGCVCSNWGEDHNTEHFNSDNQS

SEQ ID NO: 209701 - protein, 39 aa, Artificial Sequence
  Description of Artificial Sequence: Synthetic polypeptide
ADMCISTTNPVATEQYGQCVCSNWEEDHNAENFQSDTQA

SEQ ID NO: 209702 - protein, 39 aa, Artificial Sequence
  Description of Artificial Sequence: Synthetic polypeptide
ADMCISTTNPVATEQYGQCVCSNSGEDHNAEYFNSDNQP

SEQ ID NO: 209703 - protein, 37 aa, Artificial Sequence
  Description of Artificial Sequence: Synthetic polypeptide
CEEVIACTNPVATEQWGCCAINNTIDISNPPGEQDAE

SEQ ID NO: 209704 - protein, 37 aa, Artificial Sequence
  Description of Artificial Sequence: Synthetic polypeptide
QESQIAPTNPCSYEQYGVTVSCWGHMGSQNSNGGTDR

SEQ ID NO: 209705 - protein, 38 aa, Artificial Sequence
  Description of Artificial Sequence: Synthetic polypeptide
DEAEIRTTNPIATEGWGCQTCQNAEEDNAENSNSDNQS

SEQ ID NO: 209706 - protein, 40 aa, Artificial Sequence
  Description of Artificial Sequence: Synthetic polypeptide
YEEWIRQEPHNPLYACYLQFYEGPSCVCTTALLQRPEYNQ

SEQ ID NO: 209707 - protein, 40 aa, Artificial Sequence
  Description of Artificial Sequence: Synthetic polypeptide
DEECISTTNPVATEGYGQCQVCSNWGEDHNAENFISETQS

SEQ ID NO: 209708 - protein, 39 aa, Artificial Sequence
  Description of Artificial Sequence: Synthetic polypeptide
ADEEISTTNPVAYEGYGQCVCSNWGEDHNIESFGSETQS

SEQ ID NO: 209709 - protein, 40 aa, Artificial Sequence
  Description of Artificial Sequence: Synthetic polypeptide
DEECISTTNPVATEGYGQCQVCGMSGEDHNTEHFISETQA

SEQ ID NO: 209710 - protein, 39 aa, Artificial Sequence
  Description of Artificial Sequence: Synthetic polypeptide
CEEEISTTNPVAYEGYGQCVCYNWGEDDNAEHFNSDTQS

SEQ ID NO: 209711 - protein, 39 aa, Artificial Sequence
  Description of Artificial Sequence: Synthetic polypeptide
ADEEISTTNPVAYEGYGQCVCSNWGEPHNAEYFNSDTQQ

SEQ ID NO: 209712 - protein, 39 aa, Artificial Sequence
  Description of Artificial Sequence: Synthetic polypeptide
ADEEISTTNPVAYEQYGQCVCSNWGEDDNAENFISDTQS

SEQ ID NO: 209713 - protein, 39 aa, Artificial Sequence
  Description of Artificial Sequence: Synthetic polypeptide
AEEEISCTNPVAYEGYGQCVCSNWGEGHNAEGFNSDNQP

SEQ ID NO: 209714 - protein, 37 aa, Artificial Sequence
  Description of Artificial Sequence: Synthetic polypeptide
SAEEIATTNPVAYEQWGAFNCAMNNGGEPDIGGGEMW

SEQ ID NO: 209715 - protein, 39 aa, Artificial Sequence
  Description of Artificial Sequence: Synthetic polypeptide
ADEEISTTNPVAYEQYGQCVCSNWGEDHNAEGFISDTQG

SEQ ID NO: 209716 - protein, 39 aa, Artificial Sequence
  Description of Artificial Sequence: Synthetic polypeptide
AEEEISTTNPCAYEGYGQCVCSNWEEDHNAEAFNSDNQA

SEQ ID NO: 209717 - protein, 40 aa, Artificial Sequence
  Description of Artificial Sequence: Synthetic polypeptide
AEEEISTTNPCATEGYGQCQVCSNWGEDHNAENFNSDNQS

SEQ ID NO: 209718 - protein, 39 aa, Artificial Sequence
  Description of Artificial Sequence: Synthetic polypeptide
DEMAISTTNPVAYEGYGQCVCSNSGEDHNAEGFNSDNQF

SEQ ID NO: 209719 - protein, 37 aa, Artificial Sequence
  Description of Artificial Sequence: Synthetic polypeptide
SAQEIATTNPVAYEQWGCNIAGSGFEEADMPLGNDPH

SEQ ID NO: 209720 - protein, 38 aa, Artificial Sequence
  Description of Artificial Sequence: Synthetic polypeptide
SAQEIATTNPVAYEQWGHCIIFAGNSGLVDNDGENEAE

SEQ ID NO: 209721 - protein, 39 aa, Artificial Sequence
  Description of Artificial Sequence: Synthetic polypeptide
DDECISTTNPVAYEQYGQCVCSNWEEDHNAENFISDTQS

SEQ ID NO: 209722 - protein, 39 aa, Artificial Sequence
  Description of Artificial Sequence: Synthetic polypeptide
ADEEISTTNPVAYEQYGQCVCYNWGEDNNAENFNSDTQS

SEQ ID NO: 209723 - protein, 39 aa, Artificial Sequence
  Description of Artificial Sequence: Synthetic polypeptide
ADEEISTTNPVAYEQYGQCYCSNWGEDPNAENFNSDTQS

SEQ ID NO: 209724 - protein, 39 aa, Artificial Sequence
  Description of Artificial Sequence: Synthetic polypeptide
SDAAIGTTNPVAYEQYGQCVCSNWMEDHNTENFNSDNAS

SEQ ID NO: 209725 - protein, 38 aa, Artificial Sequence
  Description of Artificial Sequence: Synthetic polypeptide
SAEEIATTNPVAYEQWGSVAACPGPAPEAGTPMEDAMW

SEQ ID NO: 209726 - protein, 39 aa, Artificial Sequence
  Description of Artificial Sequence: Synthetic polypeptide
DDECISTTNPVAYEQYGQCVCQNWEEDHNAEHFNSETQA

SEQ ID NO: 209727 - protein, 39 aa, Artificial Sequence
  Description of Artificial Sequence: Synthetic polypeptide
DDECISTTNPVAYEQYGQCVCGNWGEDHNAEYFNSDTQS

SEQ ID NO: 209728 - protein, 39 aa, Artificial Sequence
  Description of Artificial Sequence: Synthetic polypeptide
SDECIRTTNPVAYEGYGQCVCSNWEEDHNAEHFNSENQA

SEQ ID NO: 209729 - protein, 39 aa, Artificial Sequence
  Description of Artificial Sequence: Synthetic polypeptide
SDMEISTTNPVAYEGYGQCVCSTWGEDHNIESFISDNQS

SEQ ID NO: 209730 - protein, 39 aa, Artificial Sequence
  Description of Artificial Sequence: Synthetic polypeptide
DEMCIATTNPVATEGYGICVCSNWGEDDNEEHFMSETQA

SEQ ID NO: 209731 - protein, 38 aa, Artificial Sequence
  Description of Artificial Sequence: Synthetic polypeptide
SDNAISTTNPVATEGYGCVCSNWGEDHNAEHFNSDTQS

SEQ ID NO: 209732 - protein, 38 aa, Artificial Sequence
  Description of Artificial Sequence: Synthetic polypeptide
ADRCISTTNPVAYEEYGCVCSNWGEGTNAENFNSDTQS

SEQ ID NO: 209733 - protein, 39 aa, Artificial Sequence
  Description of Artificial Sequence: Synthetic polypeptide
DEECISTTNPVAYCQYGQCVCGNWGEDHNAENFISDTQG

SEQ ID NO: 209734 - protein, 38 aa, Artificial Sequence
  Description of Artificial Sequence: Synthetic polypeptide
ADREISTTNPVAYEEYGCVCQNWGEGTNAENFNSETQS

SEQ ID NO: 209735 - protein, 39 aa, Artificial Sequence
  Description of Artificial Sequence: Synthetic polypeptide
DEMCIATTNPVAYEQYGICVCSNWGEDDNEEHFISETQA

SEQ ID NO: 209736 - protein, 39 aa, Artificial Sequence
  Description of Artificial Sequence: Synthetic polypeptide
SDREISTTNPVATEEYGQCVCGNWMEGTNAENFNSETQS

SEQ ID NO: 209737 - protein, 39 aa, Artificial Sequence
  Description of Artificial Sequence: Synthetic polypeptide
SDREISTTNPVATEEYGQCVCSNWGEGHNAENFNSETQS

SEQ ID NO: 209738 - protein, 39 aa, Artificial Sequence
  Description of Artificial Sequence: Synthetic polypeptide
SDREISTTNPVAYEGYGQCVCSNWGEGTNAENFNSETQS

SEQ ID NO: 209739 - protein, 39 aa, Artificial Sequence
  Description of Artificial Sequence: Synthetic polypeptide
SDMEISTTNPVAYEEYGQCVCSTWGEGTNAENFNSETQA

SEQ ID NO: 209740 - protein, 39 aa, Artificial Sequence
  Description of Artificial Sequence: Synthetic polypeptide
DEECISTTNPVAYEAYGCAVCGNWGEDHNAENFNSDTQS

SEQ ID NO: 209741 - protein, 39 aa, Artificial Sequence
  Description of Artificial Sequence: Synthetic polypeptide
AEAAIGTTNPCAYEQYGQCVCSTWGEDHNTENFNSDNAS

SEQ ID NO: 209742 - protein, 39 aa, Artificial Sequence
  Description of Artificial Sequence: Synthetic polypeptide
DDECISTTNPVAYEGYGQCVCSNWGEDDNAEHFNSDTQA

SEQ ID NO: 209743 - protein, 39 aa, Artificial Sequence
  Description of Artificial Sequence: Synthetic polypeptide
AEAAIGTTNPVAYEEYGCQSCSNWGEDHNTENSNSDNQA

SEQ ID NO: 209744 - protein, 39 aa, Artificial Sequence
  Description of Artificial Sequence: Synthetic polypeptide
AEAAIGTTNPVAYEGYGQCQVCSWGEDHNTENFNSDNAS

SEQ ID NO: 209745 - protein, 39 aa, Artificial Sequence
  Description of Artificial Sequence: Synthetic polypeptide
AEAAIGTTNPVAYEGYGQCVCSTWGEDHNTENFISDNQS

SEQ ID NO: 209746 - protein, 39 aa, Artificial Sequence
  Description of Artificial Sequence: Synthetic polypeptide
AEAAIGTTNPVAYEQWGQCVCSNWGEDHNTENFNSDNAS

SEQ ID NO: 209747 - protein, 40 aa, Artificial Sequence
  Description of Artificial Sequence: Synthetic polypeptide
AEAAIGTTNPVAYEQYGQCQVCSNWGEDHNTENFNSDNAA

SEQ ID NO: 209748 - protein, 39 aa, Artificial Sequence
  Description of Artificial Sequence: Synthetic polypeptide
DDECISTTNPVAYEGYGQCVCSNWGEAHNIEYFNSEFQA

SEQ ID NO: 209749 - protein, 39 aa, Artificial Sequence
  Description of Artificial Sequence: Synthetic polypeptide
AEAAISCTNPVAYEQYGQCVCSNWGEDHNTENFNSDNAA

SEQ ID NO: 209750 - protein, 38 aa, Artificial Sequence
  Description of Artificial Sequence: Synthetic polypeptide
AEAAISTTNPVATEAYGQCVCGNWGEHNAENFNSDPQA

SEQ ID NO: 209751 - protein, 39 aa, Artificial Sequence
  Description of Artificial Sequence: Synthetic polypeptide
DDECISTTNPVAYEGYGQCVCSNWGEDHNAEGSNSDTQI

SEQ ID NO: 209752 - protein, 38 aa, Artificial Sequence
  Description of Artificial Sequence: Synthetic polypeptide
ENVEIATTNPVAYEQWGHIQVGRPTEGGRQQEQQQDGR

SEQ ID NO: 209753 - protein, 39 aa, Artificial Sequence
  Description of Artificial Sequence: Synthetic polypeptide
SDMEISTTNPVAYEEYGQCVCSNWMEGTNAENFNSETQS

SEQ ID NO: 209754 - protein, 37 aa, Artificial Sequence
  Description of Artificial Sequence: Synthetic polypeptide
QEAEIATTNPVAYEWYGEHAPWCEEHEFSHSHAEGEW

SEQ ID NO: 209755 - protein, 39 aa, Artificial Sequence
  Description of Artificial Sequence: Synthetic polypeptide
SDECIRTTNPVAYEGYGQCVCSNWMEDHNAENFNSETQA

SEQ ID NO: 209756 - protein, 40 aa, Artificial Sequence
  Description of Artificial Sequence: Synthetic polypeptide
SDECIRTTNPVAYEQYGQCIVCSNWGEDHNAESFNSETQL

SEQ ID NO: 209757 - protein, 39 aa, Artificial Sequence
  Description of Artificial Sequence: Synthetic polypeptide
SDECISCTNPVATEQYGQCVCQNWGEGHNAENFNSDTAN

SEQ ID NO: 209758 - protein, 40 aa, Artificial Sequence
  Description of Artificial Sequence: Synthetic polypeptide
DEAEISTTNPVAYEYYGQCQVCSNWGEDDNAENFNSDNQS

SEQ ID NO: 209759 - protein, 39 aa, Artificial Sequence
  Description of Artificial Sequence: Synthetic polypeptide
SDECISTTNPVATEGYGQCVCSNWEEDHNAENINSDTQS

SEQ ID NO: 209760 - protein, 39 aa, Artificial Sequence
  Description of Artificial Sequence: Synthetic polypeptide
SDECISTTNPVATEHYGQCVCSNWGEDHNAENFISDNQN

SEQ ID NO: 209761 - protein, 38 aa, Artificial Sequence
  Description of Artificial Sequence: Synthetic polypeptide
SDECISTTNPVAYEGYGQCVCSNWEEHNIENFSSDNQS

SEQ ID NO: 209762 - protein, 38 aa, Artificial Sequence
  Description of Artificial Sequence: Synthetic polypeptide
SDECISTTNPVAYEGYGQCVCSNWGEHNAENFNSDNQG

SEQ ID NO: 209763 - protein, 39 aa, Artificial Sequence
  Description of Artificial Sequence: Synthetic polypeptide
DDECISTTNPVAYEGYGQCVCSNWGEGHNAEYFNSDNQS

SEQ ID NO: 209764 - protein, 38 aa, Artificial Sequence
  Description of Artificial Sequence: Synthetic polypeptide
SDEEISCTNPVAYEGYGQCVCSMSGEHNAENFQSDTQS

SEQ ID NO: 209765 - protein, 39 aa, Artificial Sequence
  Description of Artificial Sequence: Synthetic polypeptide
SDMCISTTNPVAYEQYGICVCSNWGEDHNTENFNSDNQA

SEQ ID NO: 209766 - protein, 39 aa, Artificial Sequence
  Description of Artificial Sequence: Synthetic polypeptide
SDEEISTTNPVATEGYGQCVCSMSGEDHNAENFISDTQA

SEQ ID NO: 209767 - protein, 39 aa, Artificial Sequence
  Description of Artificial Sequence: Synthetic polypeptide
SDEEISTTNPVAYEGYGQCVCGNWGEGHNAENFNSDTAN

SEQ ID NO: 209768 - protein, 40 aa, Artificial Sequence
  Description of Artificial Sequence: Synthetic polypeptide
AEEEISCTNPVATEGYGQCAVCSNWGEPHNAENFNSEFQS

SEQ ID NO: 209769 - protein, 39 aa, Artificial Sequence
  Description of Artificial Sequence: Synthetic polypeptide
SDEEISTTNPVAYEGYGQCVCSNWGEDPNAENFNSDPQA

SEQ ID NO: 209770 - protein, 38 aa, Artificial Sequence
  Description of Artificial Sequence: Synthetic polypeptide
SDEEISTTNPVAYEGYGQCVCSNWGEHNAENFISEPQA

SEQ ID NO: 209771 - protein, 40 aa, Artificial Sequence
  Description of Artificial Sequence: Synthetic polypeptide
AEEEISCTNPVATEAYGQCQVCSNSGEDHNAENFNSQTQA

SEQ ID NO: 209772 - protein, 39 aa, Artificial Sequence
  Description of Artificial Sequence: Synthetic polypeptide
SDEEISTTNPVAYEQYGQCVCQNWGEDHNAEYSNSEFQA

SEQ ID NO: 209773 - protein, 39 aa, Artificial Sequence
  Description of Artificial Sequence: Synthetic polypeptide
SDEEISTTNPVAYEQYGQCVCSNWGEDHNAEFFISEPQA

SEQ ID NO: 209774 - protein, 39 aa, Artificial Sequence
  Description of Artificial Sequence: Synthetic polypeptide
AEEEISCTNPCATEGYGQCVCSNWEEDHNAEGFNSDTQS

SEQ ID NO: 209775 - protein, 39 aa, Artificial Sequence
  Description of Artificial Sequence: Synthetic polypeptide
DDECISTTNPVAYEGYGQCVCSNWGEDHNAEYFNSDTQA

SEQ ID NO: 209776 - protein, 39 aa, Artificial Sequence
  Description of Artificial Sequence: Synthetic polypeptide
SDMCISTTNPVATEQYGQCVCSNWGEDHNTENFNSDTQN

SEQ ID NO: 209777 - protein, 39 aa, Artificial Sequence
  Description of Artificial Sequence: Synthetic polypeptide
SDEEISTTNPVAYCQYGQCIVCSNWGEHNAENFNSDTQS

SEQ ID NO: 209778 - protein, 39 aa, Artificial Sequence
  Description of Artificial Sequence: Synthetic polypeptide
AEAEISTTNPVAYEYYGQCVCSNWGEDHNAENFQSDTQP

SEQ ID NO: 209779 - protein, 39 aa, Artificial Sequence
  Description of Artificial Sequence: Synthetic polypeptide
ENSEIATTNPVAYEAWGVVAISVTGNWDEQEQKGMGQDH

SEQ ID NO: 209780 - protein, 39 aa, Artificial Sequence
  Description of Artificial Sequence: Synthetic polypeptide
DEECISTTNPVAYEGYGQCVCGNWGYDPNAENFNSETQS

SEQ ID NO: 209781 - protein, 39 aa, Artificial Sequence
  Description of Artificial Sequence: Synthetic polypeptide
SEECISTTNPVAYEGYGCAVCSNWGEDHNAEYFNSETQS

SEQ ID NO: 209782 - protein, 38 aa, Artificial Sequence
  Description of Artificial Sequence: Synthetic polypeptide
CEEVIACTNPVAYEQWGHCRFVATGEHADIGNSDESAM

SEQ ID NO: 209783 - protein, 39 aa, Artificial Sequence
  Description of Artificial Sequence: Synthetic polypeptide
AEAEISTTNPVAYEGYGQCVCSNWGEDDNAENFNSDPQL

SEQ ID NO: 209784 - protein, 39 aa, Artificial Sequence
  Description of Artificial Sequence: Synthetic polypeptide
AEAEISTTNPVAYEGYGQCVCSNWGEDDNIENFQSDFQS

SEQ ID NO: 209785 - protein, 38 aa, Artificial Sequence
  Description of Artificial Sequence: Synthetic polypeptide
CEFPVIRVTNSPVMTEVQVYRVALTFNSEFVRVGEPVS

SEQ ID NO: 209786 - protein, 39 aa, Artificial Sequence
  Description of Artificial Sequence: Synthetic polypeptide
ADECISTTNPVAYEQYGQCVCSNWGEDPNTENFISETQS

SEQ ID NO: 209787 - protein, 39 aa, Artificial Sequence
  Description of Artificial Sequence: Synthetic polypeptide
ADECISTTNPVAYEQYGQCVCSNWGEDHNAENFGSDTQA

SEQ ID NO: 209788 - protein, 39 aa, Artificial Sequence
  Description of Artificial Sequence: Synthetic polypeptide
AEAEISTTNPVAYEGYGQCVCSNWGEDHNAENFNSDNQG

SEQ ID NO: 209789 - protein, 39 aa, Artificial Sequence
  Description of Artificial Sequence: Synthetic polypeptide
AEAEISTTNPVAYEGYGQCVCSNWGEDHNAENFNSDTQA

SEQ ID NO: 209790 - protein, 38 aa, Artificial Sequence
  Description of Artificial Sequence: Synthetic polypeptide
ADECISTTNPVAYEQYGQCICSNWGEDNAENFISENQL

SEQ ID NO: 209791 - protein, 39 aa, Artificial Sequence
  Description of Artificial Sequence: Synthetic polypeptide
DEAEIRTTNPCATEGWGICQTCQNWEEDNAENSNSDNQA

SEQ ID NO: 209792 - protein, 39 aa, Artificial Sequence
  Description of Artificial Sequence: Synthetic polypeptide
ADECISTTNPVAYEQYGICVCSNWGEDHNTENFNSQTQA

SEQ ID NO: 209793 - protein, 39 aa, Artificial Sequence
  Description of Artificial Sequence: Synthetic polypeptide
AEAEISTTNPVAYEGYGQCVCSNWGEDHNAEYFNSEFQF

SEQ ID NO: 209794 - protein, 38 aa, Artificial Sequence
  Description of Artificial Sequence: Synthetic polypeptide
ADECISTTNPVAYEGYGQCVCSNWGEHNAEYFNSDTQS

SEQ ID NO: 209795 - protein, 39 aa, Artificial Sequence
  Description of Artificial Sequence: Synthetic polypeptide
AEAEISTTNPVAYEGYGQCVCSNWGEDHNIESSNSDNAS

SEQ ID NO: 209796 - protein, 39 aa, Artificial Sequence
  Description of Artificial Sequence: Synthetic polypeptide
AEAEISTTNPVAYEGYGQCVCSNWGEDPNAENFNSDNQS

SEQ ID NO: 209797 - protein, 39 aa, Artificial Sequence
  Description of Artificial Sequence: Synthetic polypeptide
AEAEISTTNPVAYEGYGQCVCSNWGEGHNAEGFNSDTQA

SEQ ID NO: 209798 - protein, 39 aa, Artificial Sequence
  Description of Artificial Sequence: Synthetic polypeptide
SEECISTTNPVAYEGYGQCSCGNWEALHNAEHFNSDNQS

SEQ ID NO: 209799 - protein, 38 aa, Artificial Sequence
  Description of Artificial Sequence: Synthetic polypeptide
AEAEISTTNPVAYEGYGQCVCSNWGEHNIENFISETQS

SEQ ID NO: 209800 - protein, 39 aa, Artificial Sequence
  Description of Artificial Sequence: Synthetic polypeptide
AEAEISTTNPVAYEGYGQCVCSNWMEDDNAENFNSENQS

SEQ ID NO: 209801 - protein, 39 aa, Artificial Sequence
  Description of Artificial Sequence: Synthetic polypeptide
AEAEISTTNPVAYEGYGQCVCSNWMEDHNAENFNSDTQI

SEQ ID NO: 209802 - protein, 39 aa, Artificial Sequence
  Description of Artificial Sequence: Synthetic polypeptide
QAEEIATTNPVAYEPWGHSFVSAGAGEGDGATMDPNESM

SEQ ID NO: 209803 - protein, 39 aa, Artificial Sequence
  Description of Artificial Sequence: Synthetic polypeptide
AEAEISTTNPVAYEGYGQCVCSNWEEDHNAENFQSDTQA

SEQ ID NO: 209804 - protein, 39 aa, Artificial Sequence
  Description of Artificial Sequence: Synthetic polypeptide
QAEEIATTNPVAYEQPWGHNFVSAGAGEGDGATGPNESF

SEQ ID NO: 209805 - protein, 37 aa, Artificial Sequence
  Description of Artificial Sequence: Synthetic polypeptide
QAEEIATTNPVAYEQWATSFCAMNNGGEPDIGGGEMW

SEQ ID NO: 209806 - protein, 40 aa, Artificial Sequence
  Description of Artificial Sequence: Synthetic polypeptide
DEECISCTNPVATEGYGQCQVCSNWGEDHNAENSNSDNQS

SEQ ID NO: 209807 - protein, 39 aa, Artificial Sequence
  Description of Artificial Sequence: Synthetic polypeptide
QAEEIATTNPVAYEQWGTSFVCAMNNGGEPDIGGDGEMW

SEQ ID NO: 209808 - protein, 39 aa, Artificial Sequence
  Description of Artificial Sequence: Synthetic polypeptide
AEAEISTTNPVAYEEYGQCQVCSNWGEPNAENFNSDTQS

SEQ ID NO: 209809 - protein, 39 aa, Artificial Sequence
  Description of Artificial Sequence: Synthetic polypeptide
MEEAISTTNPVAYEGYGCAVCSNWGEDHNAESFNSDTQA

SEQ ID NO: 209810 - protein, 39 aa, Artificial Sequence
  Description of Artificial Sequence: Synthetic polypeptide
MEECISTTNPVAYEQYGQCVCYNWGEDDNTENFNSETQL

SEQ ID NO: 209811 - protein, 40 aa, Artificial Sequence
  Description of Artificial Sequence: Synthetic polypeptide
DEAEISTTNPVAYEQYGQCQVCGNWGEDHNAEYFNSDTQA

SEQ ID NO: 209812 - protein, 40 aa, Artificial Sequence
  Description of Artificial Sequence: Synthetic polypeptide
MEEEIATTNPVATEQWGCTNNQANGNGVDTATANYDEEWP

SEQ ID NO: 209813 - protein, 40 aa, Artificial Sequence
  Description of Artificial Sequence: Synthetic polypeptide
DEEEICTTNPVGYYEPQWGSICAVADAALGTAHGGDLAAM

SEQ ID NO: 209814 - protein, 39 aa, Artificial Sequence
  Description of Artificial Sequence: Synthetic polypeptide
SEECISCTNPVATEGYGQCVCSNWGEDHNAENFNSENQL

SEQ ID NO: 209815 - protein, 39 aa, Artificial Sequence
  Description of Artificial Sequence: Synthetic polypeptide
SEECISCTNPVATEGYGQCVCSNWGEDHNAEYFNSDNQS

SEQ ID NO: 209816 - protein, 39 aa, Artificial Sequence
  Description of Artificial Sequence: Synthetic polypeptide
SEECISTTNPVAYEGYGQCVCSDWEPDHNAENFNSDFQS

SEQ ID NO: 209817 - protein, 39 aa, Artificial Sequence
  Description of Artificial Sequence: Synthetic polypeptide
SEECISCTNPVATEGYGQCVCSNWMEDHNAENFNSETQA

SEQ ID NO: 209818 - protein, 39 aa, Artificial Sequence
  Description of Artificial Sequence: Synthetic polypeptide
DEAEIATTNPVATEQWGCTNNQANMNGVDTATAADEEWM

SEQ ID NO: 209819 - protein, 39 aa, Artificial Sequence
  Description of Artificial Sequence: Synthetic polypeptide
SEECISTTNPCAYEQYGQCVCQNSGYDHNAENFNSDTQA

SEQ ID NO: 209820 - protein, 40 aa, Artificial Sequence
  Description of Artificial Sequence: Synthetic polypeptide
SEECISTTNPVATEGYGQCQVCSNSGEDHNAEHFNSDTQA

SEQ ID NO: 209821 - protein, 39 aa, Artificial Sequence
  Description of Artificial Sequence: Synthetic polypeptide
AEAEISTTNPVAYEGYGQCQVCSNWGEHNAENFNSDTQS

SEQ ID NO: 209822 - protein, 40 aa, Artificial Sequence
  Description of Artificial Sequence: Synthetic polypeptide
AEEEISTTNPVAYEGYGQCAVCGNWGELDNAENFISDNQS

SEQ ID NO: 209823 - protein, 38 aa, Artificial Sequence
  Description of Artificial Sequence: Synthetic polypeptide
AEAEISTTNPVAYEGYGQCVCSMWEEHDAENFISDTQS

SEQ ID NO: 209824 - protein, 39 aa, Artificial Sequence
  Description of Artificial Sequence: Synthetic polypeptide
AEAEISTTNPVAYEGYGQCVCSNSGEDDNAEHFNSETQS

SEQ ID NO: 209825 - protein, 40 aa, Artificial Sequence
  Description of Artificial Sequence: Synthetic polypeptide
SEECISTTNPVATEQYGQCVVCSNWGEDHNIENFISEFQS

SEQ ID NO: 209826 - protein, 39 aa, Artificial Sequence
  Description of Artificial Sequence: Synthetic polypeptide
AEAEISTTNPVAYEGYGQCVCSNSGEDHNAEYFNSDNQA

SEQ ID NO: 209827 - protein, 37 aa, Artificial Sequence
  Description of Artificial Sequence: Synthetic polypeptide
QAEEIATTNPVAYEQWGAFACAMNNGGEPDIGGIEMW

SEQ ID NO: 209828 - protein, 38 aa, Artificial Sequence
  Description of Artificial Sequence: Synthetic polypeptide
SEECISCTNPVAYEEYGQCVCQNSGEHNAEYFNSDNQS

SEQ ID NO: 209829 - protein, 39 aa, Artificial Sequence
  Description of Artificial Sequence: Synthetic polypeptide
MEAEISTTNPVAYEQYGQCVCSNWGEDHNAENFISDTQA

SEQ ID NO: 209830 - protein, 39 aa, Artificial Sequence
  Description of Artificial Sequence: Synthetic polypeptide
AEAEISTTNPVAYEHYGQCIVCSNWGEHNAENFNSDTQA

SEQ ID NO: 209831 - protein, 39 aa, Artificial Sequence
  Description of Artificial Sequence: Synthetic polypeptide
AEAEISTTNPVAYEQWGQCVCSNWGEDHNAEFFNSDTQS

SEQ ID NO: 209832 - protein, 39 aa, Artificial Sequence
  Description of Artificial Sequence: Synthetic polypeptide
DEMEIVTTNPVAYEGYGICVCSNWGEDPNAENFISDTQA

SEQ ID NO: 209833 - protein, 39 aa, Artificial Sequence
  Description of Artificial Sequence: Synthetic polypeptide
DEMEIVTTNPVAYEGYGQCVCSNWGEDPNAEYFISDTQS

SEQ ID NO: 209834 - protein, 37 aa, Artificial Sequence
  Description of Artificial Sequence: Synthetic polypeptide
MEPEVLTSVQNPVAAEQYCIMNMPTNRTQNEDGDDQQ

SEQ ID NO: 209835 - protein, 38 aa, Artificial Sequence
  Description of Artificial Sequence: Synthetic polypeptide
DEEEIACTNPVATEQWGCTTIFAGAGMHGPDDSGEGAS

SEQ ID NO: 209836 - protein, 38 aa, Artificial Sequence
  Description of Artificial Sequence: Synthetic polypeptide
DEEEIACTNPVATEQWGCTTIFAGGAMHGPDDSGEGAQ

SEQ ID NO: 209837 - protein, 39 aa, Artificial Sequence
  Description of Artificial Sequence: Synthetic polypeptide
AEAEISTTNPVAYEQYGQCVCSNWGEDHNAENFMSDTQA

SEQ ID NO: 209838 - protein, 39 aa, Artificial Sequence
  Description of Artificial Sequence: Synthetic polypeptide
ADECISTTNPVAYEGYGICQVCSNWGEHNTENFNSDNQA

SEQ ID NO: 209839 - protein, 39 aa, Artificial Sequence
  Description of Artificial Sequence: Synthetic polypeptide
ADECISTTNPVATEQYGQCVCSNWGEDHNAEGFISDTQA

SEQ ID NO: 209840 - protein, 39 aa, Artificial Sequence
  Description of Artificial Sequence: Synthetic polypeptide
ADECISTTNPVATEQYGQCICSNWGPDPNAENFNSDTQS

SEQ ID NO: 209841 - protein, 37 aa, Artificial Sequence
  Description of Artificial Sequence: Synthetic polypeptide
MEQEIATTNPVAYEQWGHCIIFAGNSGLVDNDLDDAE

SEQ ID NO: 209842 - protein, 38 aa, Artificial Sequence
  Description of Artificial Sequence: Synthetic polypeptide
MEQEIATTNPVAYEQWGHCIIFAGNSGLVDNDSENDAE

SEQ ID NO: 209843 - protein, 39 aa, Artificial Sequence
  Description of Artificial Sequence: Synthetic polypeptide
DEGEIRTTNPCAYEPYGGNPCAAITAGLPATAPGGEMWH

SEQ ID NO: 209844 - protein, 39 aa, Artificial Sequence
  Description of Artificial Sequence: Synthetic polypeptide
AEAEISTTNPVAYEQYGQCVCSNWGEDHNAENFPSDTQP

SEQ ID NO: 209845 - protein, 38 aa, Artificial Sequence
  Description of Artificial Sequence: Synthetic polypeptide
DEGEIRTTNPIATECWGATTPANQGDAWSSEPTGTPYI

SEQ ID NO: 209846 - protein, 38 aa, Artificial Sequence
  Description of Artificial Sequence: Synthetic polypeptide
DEAEIATTNPIATECWGATYYANENDHQLHEKKGKGMS

SEQ ID NO: 209847 - protein, 38 aa, Artificial Sequence
  Description of Artificial Sequence: Synthetic polypeptide
MESEIATTNPMATEIYGECVCPDTRVPEEAMEGFGVEN

SEQ ID NO: 209848 - protein, 39 aa, Artificial Sequence
  Description of Artificial Sequence: Synthetic polypeptide
AEAEISTTNPVAYEQYGQCVCSNWGEDHNAEYFISEFQS

SEQ ID NO: 209849 - protein, 39 aa, Artificial Sequence
  Description of Artificial Sequence: Synthetic polypeptide
AEEEISTTNPVAYEGYGQCVCYNWGEDDNTENFNSETQL

SEQ ID NO: 209850 - protein, 39 aa, Artificial Sequence
  Description of Artificial Sequence: Synthetic polypeptide
DDECISTTNPVATEHYGQCVCSNWGEDHNAENFISDTQA

SEQ ID NO: 209851 - protein, 40 aa, Artificial Sequence
  Description of Artificial Sequence: Synthetic polypeptide
AEEEISTTNPVAYEQYGQCQVCQNWGEDHNAEYSNSEFQA

SEQ ID NO: 209852 - protein, 40 aa, Artificial Sequence
  Description of Artificial Sequence: Synthetic polypeptide
AEEEISTTNPVAYEQYGQCQVCSNWGEDHNAENFISDTQA

SEQ ID NO: 209853 - protein, 39 aa, Artificial Sequence
  Description of Artificial Sequence: Synthetic polypeptide
DENEIATTNPVAYEGYGQCVCGNWGEDHNAENFNSDNQN

SEQ ID NO: 209854 - protein, 39 aa, Artificial Sequence
  Description of Artificial Sequence: Synthetic polypeptide
MELEIKTTNPAATEFYGMSEDGDDENMDPGNMDDAQQED

SEQ ID NO: 209855 - protein, 39 aa, Artificial Sequence
  Description of Artificial Sequence: Synthetic polypeptide
DEHEIATTNPVATYAPPWGVTSGEGEPLGIAHAGDNSDH

SEQ ID NO: 209856 - protein, 39 aa, Artificial Sequence
  Description of Artificial Sequence: Synthetic polypeptide
AEAEISTTNPVAYEQYGQCVCGNWGEDHNAEYFISDTQP

SEQ ID NO: 209857 - protein, 39 aa, Artificial Sequence
  Description of Artificial Sequence: Synthetic polypeptide
SEECISTTNPVAYEGYGQCVCSNSMEDHNAEYFNSETQS

SEQ ID NO: 209858 - protein, 39 aa, Artificial Sequence
  Description of Artificial Sequence: Synthetic polypeptide
SEECISTTNPVAYEGYGQCVCSNWEEDHNAENFPSDNQL

SEQ ID NO: 209859 - protein, 39 aa, Artificial Sequence
  Description of Artificial Sequence: Synthetic polypeptide
SEECISTTNPVAYEGYGQCVCSNWGEDDNAENFNSDTQA

SEQ ID NO: 209860 - protein, 39 aa, Artificial Sequence
  Description of Artificial Sequence: Synthetic polypeptide
MEEEISTTNPVAYEGYGQCVCYNWGEDHNAENFNSETQL

SEQ ID NO: 209861 - protein, 37 aa, Artificial Sequence
  Description of Artificial Sequence: Synthetic polypeptide
MEFLEEILRGLTNIPVVNMFEPADQSENAGQGQGDNP

SEQ ID NO: 209862 - protein, 39 aa, Artificial Sequence
  Description of Artificial Sequence: Synthetic polypeptide
AEEEISTTNPVAYEGYGQCICSNWGEDHNAEYFNSDTQS

SEQ ID NO: 209863 - protein, 40 aa, Artificial Sequence
  Description of Artificial Sequence: Synthetic polypeptide
AEEEISTTNPVAYEGYGQCQVCGNSGEDDNTENFNSETQA

SEQ ID NO: 209864 - protein, 37 aa, Artificial Sequence
  Description of Artificial Sequence: Synthetic polypeptide
DEGEIATTNPVAYAPWGTACAATAGELPDSLASNPNN

SEQ ID NO: 209865 - protein, 38 aa, Artificial Sequence
  Description of Artificial Sequence: Synthetic polypeptide
DEGEIATTNPVAYEPWGRPPPAGQGPALGTHQDGMEAV

SEQ ID NO: 209866 - protein, 39 aa, Artificial Sequence
  Description of Artificial Sequence: Synthetic polypeptide
DEAEIATTNPVATASWGCTVNLSAVGHAGPADSGEGNNH

SEQ ID NO: 209867 - protein, 39 aa, Artificial Sequence
  Description of Artificial Sequence: Synthetic polypeptide
AEAEISTTNPVAYEQWGQCVCSNSGEDHNAESFNSDTQM

SEQ ID NO: 209868 - protein, 39 aa, Artificial Sequence
  Description of Artificial Sequence: Synthetic polypeptide
DEGEIATTNPVAYEQWGHCIIFAGNSGLVDNDMSENGAP

SEQ ID NO: 209869 - protein, 39 aa, Artificial Sequence
  Description of Artificial Sequence: Synthetic polypeptide
AEEEISTTNPVAYEGYGQCVCGNWGEDDNAEYFNSENQA

SEQ ID NO: 209870 - protein, 38 aa, Artificial Sequence
  Description of Artificial Sequence: Synthetic polypeptide
ADECISTTNPVAYEGYGQCVCSNWGEDNAENFNSDNQG

SEQ ID NO: 209871 - protein, 39 aa, Artificial Sequence
  Description of Artificial Sequence: Synthetic polypeptide
DENEIATTNPVAYEQWGICVCSNSGEDHNAEYSISDTAS

SEQ ID NO: 209872 - protein, 38 aa, Artificial Sequence
  Description of Artificial Sequence: Synthetic polypeptide
DEHEIATTNPVAYAPPWGVTSGTGEPGGIAHQGDGSDD

SEQ ID NO: 209873 - protein, 39 aa, Artificial Sequence
  Description of Artificial Sequence: Synthetic polypeptide
AEEEISTTNPVAYEGYGQCVCSNWEEDHNAENFISDTQS

SEQ ID NO: 209874 - protein, 40 aa, Artificial Sequence
  Description of Artificial Sequence: Synthetic polypeptide
AEAEISTTNPVAYEQYGQCIVCSNWGEDHNTENFNSETQA

SEQ ID NO: 209875 - protein, 40 aa, Artificial Sequence
  Description of Artificial Sequence: Synthetic polypeptide
AEAEISTTNPVAYEQYGQCQVCSNWGEDHNAEYFNSDNQA

SEQ ID NO: 209876 - protein, 39 aa, Artificial Sequence
  Description of Artificial Sequence: Synthetic polypeptide
AEAEISTTNPVAYEQYGQCVCENWGEDHNAENFISDTQN

SEQ ID NO: 209877 - protein, 39 aa, Artificial Sequence
  Description of Artificial Sequence: Synthetic polypeptide
AEAEISTTNPVAYEQYGQCVCGNWEEDTNAENFISDTQQ

SEQ ID NO: 209878 - protein, 39 aa, Artificial Sequence
  Description of Artificial Sequence: Synthetic polypeptide
DEHEIATTNPVAYAAPPWGVTSGTGEPLGIAHQADNSDD

SEQ ID NO: 209879 - protein, 39 aa, Artificial Sequence
  Description of Artificial Sequence: Synthetic polypeptide
AEEEISTTNPVAYEGYGQCVCGNWGEDDNAEFFNSDTQS

SEQ ID NO: 209880 - protein, 39 aa, Artificial Sequence
  Description of Artificial Sequence: Synthetic polypeptide
MEAEISTTNPVAYEQYGQCVCGNWGEDHNIEYFNSDTQA

SEQ ID NO: 209881 - protein, 39 aa, Artificial Sequence
  Description of Artificial Sequence: Synthetic polypeptide
MDNCIRTTNPCATEQYGQCVCSNWGEDHNAENFNSDNQS

SEQ ID NO: 209882 - protein, 39 aa, Artificial Sequence
  Description of Artificial Sequence: Synthetic polypeptide
MDAEISTTNPVATEGYGQCVCSNWGEDHNAENFNSDNAS

SEQ ID NO: 209883 - protein, 38 aa, Artificial Sequence
  Description of Artificial Sequence: Synthetic polypeptide
SEAEISTTNPVAYEGYGCVCQNWGEDHNAENFNSDTQG

SEQ ID NO: 209884 - protein, 39 aa, Artificial Sequence
  Description of Artificial Sequence: Synthetic polypeptide
SEAEISTTNPVAYEGYGQCSCQNWEALHNAEHFNSDNQS

SEQ ID NO: 209885 - protein, 39 aa, Artificial Sequence
  Description of Artificial Sequence: Synthetic polypeptide
SEAEISTTNPVAYEGYGQCSCSMWGEDHNAENFNSENQS

SEQ ID NO: 209886 - protein, 39 aa, Artificial Sequence
  Description of Artificial Sequence: Synthetic polypeptide
SEAEISTTNPVAYEGYGQCVCGNWGEDPNIEGFNSDNQS

SEQ ID NO: 209887 - protein, 39 aa, Artificial Sequence
  Description of Artificial Sequence: Synthetic polypeptide
SEAEISTTNPVAYEGYGQCVCSNSEEDDNQENFNSDNQA

SEQ ID NO: 209888 - protein, 39 aa, Artificial Sequence
  Description of Artificial Sequence: Synthetic polypeptide
SEAEISTTNPVAYEGYGQCVCSNSGEDHNIESFNSDTQA

SEQ ID NO: 209889 - protein, 39 aa, Artificial Sequence
  Description of Artificial Sequence: Synthetic polypeptide
SEAEISTTNPVAYEGYGQCVCSNWGEGHNIEGFNSDNQA

SEQ ID NO: 209890 - protein, 40 aa, Artificial Sequence
  Description of Artificial Sequence: Synthetic polypeptide
AEAEISCTNPVATEGYGQCQVCSTWGEDHNAENFNSDTQS

SEQ ID NO: 209891 - protein, 39 aa, Artificial Sequence
  Description of Artificial Sequence: Synthetic polypeptide
SEAEISTTNPVAYEGYGQCVCSNWMEDHNAENFNSETQA

SEQ ID NO: 209892 - protein, 39 aa, Artificial Sequence
  Description of Artificial Sequence: Synthetic polypeptide
SEAEISTTNPVAYEQWGQCVCSNWGEDHNAEGFNSDNQM

SEQ ID NO: 209893 - protein, 38 aa, Artificial Sequence
  Description of Artificial Sequence: Synthetic polypeptide
SEAEISTTNPVAYEQYGCICSNWGEDDNEENFPSDTQA

SEQ ID NO: 209894 - protein, 39 aa, Artificial Sequence
  Description of Artificial Sequence: Synthetic polypeptide
AEAEISCTNPVATEQYGQCVCSNWGEDHNAENFFSDTQS

SEQ ID NO: 209895 - protein, 39 aa, Artificial Sequence
  Description of Artificial Sequence: Synthetic polypeptide
AEAEISCTNPVATEYYGQCVCQNSGEDDNEENFNSDTQF

SEQ ID NO: 209896 - protein, 38 aa, Artificial Sequence
  Description of Artificial Sequence: Synthetic polypeptide
AEAEISCTNPVAYEGYGCVCGNWGEDPNIEGFNSDNQS

SEQ ID NO: 209897 - protein, 38 aa, Artificial Sequence
  Description of Artificial Sequence: Synthetic polypeptide
AEAEISCTNPVAYEQYGCVCGNWGEDHNAENFNSDTQI

SEQ ID NO: 209898 - protein, 38 aa, Artificial Sequence
  Description of Artificial Sequence: Synthetic polypeptide
SEAEISTTNPVAYEQYGQCICSNWGEDNEEYFPSDTQS

SEQ ID NO: 209899 - protein, 40 aa, Artificial Sequence
  Description of Artificial Sequence: Synthetic polypeptide
SEAEISTTNPVAYEQYGQCQVCSNWEEDHNAEYFNSDTQS

SEQ ID NO: 209900 - protein, 39 aa, Artificial Sequence
  Description of Artificial Sequence: Synthetic polypeptide
DEAVIRTTNPVAYEGYGQCVCENWGEDPNAEYFGSDTQS

SEQ ID NO: 209901 - protein, 39 aa, Artificial Sequence
  Description of Artificial Sequence: Synthetic polypeptide
AEAEISCTNPVAYEQYGQCVCSNWEEDHNAENFQSDTQA

SEQ ID NO: 209902 - protein, 39 aa, Artificial Sequence
  Description of Artificial Sequence: Synthetic polypeptide
AEAEISCTNPVAYEQYGQCVCSNWEYDDNTESFNSETQS

SEQ ID NO: 209903 - protein, 38 aa, Artificial Sequence
  Description of Artificial Sequence: Synthetic polypeptide
CEEVIACTNPVATEQYGCINPAANEHPEAGAPDDEAAG

SEQ ID NO: 209904 - protein, 39 aa, Artificial Sequence
  Description of Artificial Sequence: Synthetic polypeptide
SEAEISTTNPVAYEGYGCAVCSNWGEDHNAENFNSDTQA

SEQ ID NO: 209905 - protein, 39 aa, Artificial Sequence
  Description of Artificial Sequence: Synthetic polypeptide
SEAEISTTNPVAYEEYGQCVCSNWGEDHNAEYFNSDNQG

SEQ ID NO: 209906 - protein, 39 aa, Artificial Sequence
  Description of Artificial Sequence: Synthetic polypeptide
SEAEISTTNPVAYEEYGQCVCSNWGEDHNAEYFNSDNQA

SEQ ID NO: 209907 - protein, 39 aa, Artificial Sequence
  Description of Artificial Sequence: Synthetic polypeptide
SEAEISTTNPVAYEEYGQCVCSNWGEDHNAENSNSDTQS

SEQ ID NO: 209908 - protein, 39 aa, Artificial Sequence
  Description of Artificial Sequence: Synthetic polypeptide
DEECISTTNPVAYEGYGQCVCGNWVEDHNAENFNSDPQL

SEQ ID NO: 209909 - protein, 37 aa, Artificial Sequence
  Description of Artificial Sequence: Synthetic polypeptide
SEAEIACTNPVGTEGYGQCSCQSGEDNQEHFMSDTQS

SEQ ID NO: 209910 - protein, 39 aa, Artificial Sequence
  Description of Artificial Sequence: Synthetic polypeptide
DEECISTTNPVAYEGYGQCVCGTWGEDHNAENFISETQS

SEQ ID NO: 209911 - protein, 39 aa, Artificial Sequence
  Description of Artificial Sequence: Synthetic polypeptide
SEAEIATTNPVATAQWGNVNNNAGEGGGTNQPDQMPDDH

SEQ ID NO: 209912 - protein, 39 aa, Artificial Sequence
  Description of Artificial Sequence: Synthetic polypeptide
DEECISTTNPVAYEGYGQCVCPNSGEDHNAENFMSDTQL

SEQ ID NO: 209913 - protein, 39 aa, Artificial Sequence
  Description of Artificial Sequence: Synthetic polypeptide
ADEEISTTNPVATCAYGQCVCSNWGEDHNAENFNSDTQA

SEQ ID NO: 209914 - protein, 39 aa, Artificial Sequence
  Description of Artificial Sequence: Synthetic polypeptide
DEECISTTNPVAYEGYGQCVCPNWGEDHNAENFNSQTQS

SEQ ID NO: 209915 - protein, 39 aa, Artificial Sequence
  Description of Artificial Sequence: Synthetic polypeptide
DEECISTTNPVAYEGYGQCVCPNWGEDHNAEYFNSDTQA

SEQ ID NO: 209916 - protein, 39 aa, Artificial Sequence
  Description of Artificial Sequence: Synthetic polypeptide
GEYYEWMIARKTLNITVYFCEQYNSIFSRTDTARGGNCF

SEQ ID NO: 209917 - protein, 40 aa, Artificial Sequence
  Description of Artificial Sequence: Synthetic polypeptide
DEECISCVNPVATEQYGQCQVCSNWEEDHNAENFNSDTQS

SEQ ID NO: 209918 - protein, 38 aa, Artificial Sequence
  Description of Artificial Sequence: Synthetic polypeptide
AEAEISTTNGVAYCQYGQCVCSNWGEHNAEYFNSDTQS

SEQ ID NO: 209919 - protein, 36 aa, Artificial Sequence
  Description of Artificial Sequence: Synthetic polypeptide
GTEAEIATTNPVAYEAWGNICATTDNQGDEDDQEHQ

SEQ ID NO: 209920 - protein, 39 aa, Artificial Sequence
  Description of Artificial Sequence: Synthetic polypeptide
DEECISCTNPVAYEGYGQCVCSNWGYDHNAEGFNSDFQA

SEQ ID NO: 209921 - protein, 39 aa, Artificial Sequence
  Description of Artificial Sequence: Synthetic polypeptide
DEECISCTNPVAYEGYGQCVCGNSGEDHNAENFGSDTQS

SEQ ID NO: 209922 - protein, 39 aa, Artificial Sequence
  Description of Artificial Sequence: Synthetic polypeptide
DEECISCTNPVAYEGYGICVCSNWGEDHNAENFNSENQL

SEQ ID NO: 209923 - protein, 38 aa, Artificial Sequence
  Description of Artificial Sequence: Synthetic polypeptide
SEAEIRTTNPVAYEGYGQCICSNWGEDNEENFPSDTQA

SEQ ID NO: 209924 - protein, 36 aa, Artificial Sequence
  Description of Artificial Sequence: Synthetic polypeptide
QESEIATTNPVAYESYGEHAPWCEHEFSIHAEGMWQ

SEQ ID NO: 209925 - protein, 38 aa, Artificial Sequence
  Description of Artificial Sequence: Synthetic polypeptide
AEAEIATTNPVAYEQYGCICSNWGEDDNEEYFPSDTQS

SEQ ID NO: 209926 - protein, 39 aa, Artificial Sequence
  Description of Artificial Sequence: Synthetic polypeptide
SEAEISCTNPVATEGYGQCVCSNSGEDHNAEYFNSDNQA

SEQ ID NO: 209927 - protein, 39 aa, Artificial Sequence
  Description of Artificial Sequence: Synthetic polypeptide
SEAEISTTNPCAYEQYGQCVCSNWGEDDNAENFNSETQN

SEQ ID NO: 209928 - protein, 40 aa, Artificial Sequence
  Description of Artificial Sequence: Synthetic polypeptide
SEAEISTTNPVATEGYGQCQSCSMWGEDDNAENFNSENQS

SEQ ID NO: 209929 - protein, 39 aa, Artificial Sequence
  Description of Artificial Sequence: Synthetic polypeptide
SEAEISTTNPVATEGYGQCVCGNWGEDHNAENFTSDNQA

SEQ ID NO: 209930 - protein, 40 aa, Artificial Sequence
  Description of Artificial Sequence: Synthetic polypeptide
DEETIRTTNPVFTEWQWNTMDDNSVPANIQEVAIPDVDAV

SEQ ID NO: 209931 - protein, 39 aa, Artificial Sequence
  Description of Artificial Sequence: Synthetic polypeptide
AEAEISTTNPCAYEQYGQCVCSNWGEDHNAESFNSDNAP

SEQ ID NO: 209932 - protein, 38 aa, Artificial Sequence
  Description of Artificial Sequence: Synthetic polypeptide
AEAEISTTNPVATCGYGQCVCGNWGEHNAENFNSDTQG

SEQ ID NO: 209933 - protein, 39 aa, Artificial Sequence
  Description of Artificial Sequence: Synthetic polypeptide
SEAEISTTNPVAYEQYGQCVCSNWGEDHNAENFISDTQA

SEQ ID NO: 209934 - protein, 39 aa, Artificial Sequence
  Description of Artificial Sequence: Synthetic polypeptide
SEDEIATTNPVAYEPQWGGCTVAANNGDGTIANPDDNGN

SEQ ID NO: 209935 - protein, 38 aa, Artificial Sequence
  Description of Artificial Sequence: Synthetic polypeptide
SEDEIATTNPVAYEPQWGGCTVAANNGDTIANPDDNGE

SEQ ID NO: 209936 - protein, 38 aa, Artificial Sequence
  Description of Artificial Sequence: Synthetic polypeptide
SEDEIATTNPVAYEPQWGGCTVAANNGGTIANPDDEGH

SEQ ID NO: 209937 - protein, 37 aa, Artificial Sequence
  Description of Artificial Sequence: Synthetic polypeptide
QCEEIATTNPVAYEAYGEHAPWCEHEFSQSHAEGEWN

SEQ ID NO: 209938 - protein, 39 aa, Artificial Sequence
  Description of Artificial Sequence: Synthetic polypeptide
SEDEIATTNPVAYEPQWGGCTVAANNGQGTIASPDDNGH

SEQ ID NO: 209939 - protein, 38 aa, Artificial Sequence
  Description of Artificial Sequence: Synthetic polypeptide
DEGEIATTNPIATECWGATYYANENDHQLHEDTGKGMS

SEQ ID NO: 209940 - protein, 39 aa, Artificial Sequence
  Description of Artificial Sequence: Synthetic polypeptide
AEEEISTTNPVAYEEYGQCVCSNWGEDHNAENFISDTQL

SEQ ID NO: 209941 - protein, 38 aa, Artificial Sequence
  Description of Artificial Sequence: Synthetic polypeptide
DEGEIATTNPIATECWGATYYANENDNQLVEKTGKGMS

SEQ ID NO: 209942 - protein, 39 aa, Artificial Sequence
  Description of Artificial Sequence: Synthetic polypeptide
AEEEISTTNPVAYEGWGQCVCSMSGEDHNAESFNSDTQA

SEQ ID NO: 209943 - protein, 38 aa, Artificial Sequence
  Description of Artificial Sequence: Synthetic polypeptide
DEGEIATTNPIATECWGATYYPNENDHQLHEKTGKGDS

SEQ ID NO: 209944 - protein, 39 aa, Artificial Sequence
  Description of Artificial Sequence: Synthetic polypeptide
SEDEIATTNPVATEQWGCIIFAGNGTGGTPDSWDDNTND

SEQ ID NO: 209945 - protein, 40 aa, Artificial Sequence
  Description of Artificial Sequence: Synthetic polypeptide
AEAEISTTNPVATEQYGQCAVCSNWGEPHNAENFISETQS

SEQ ID NO: 209946 - protein, 38 aa, Artificial Sequence
  Description of Artificial Sequence: Synthetic polypeptide
AEEEISTTNPVAYEGYGCTCSMWEEDDNAEYIISDTQA

SEQ ID NO: 209947 - protein, 41 aa, Artificial Sequence
  Description of Artificial Sequence: Synthetic polypeptide
DEQGTIYRTVNFPWIACTEQYGVQVGVSVILDHQLTIVLRI

SEQ ID NO: 209948 - protein, 38 aa, Artificial Sequence
  Description of Artificial Sequence: Synthetic polypeptide
SEEAIRTTNPADSTIELTYGNTCPDQNENEPPNGNEFN

SEQ ID NO: 209949 - protein, 39 aa, Artificial Sequence
  Description of Artificial Sequence: Synthetic polypeptide
DEECISCTNPVATEGYGQCVCGNWGEDHNAEHFNSDTQS

SEQ ID NO: 209950 - protein, 39 aa, Artificial Sequence
  Description of Artificial Sequence: Synthetic polypeptide
SEEAISTTNPVATEGWGQCVCSNWGEDHNAEHFNSDTQL

SEQ ID NO: 209951 - protein, 40 aa, Artificial Sequence
  Description of Artificial Sequence: Synthetic polypeptide
SEEAISTTNPVATEGYGQCAVCSNWGEDHNAESFNSDTQA

SEQ ID NO: 209952 - protein, 39 aa, Artificial Sequence
  Description of Artificial Sequence: Synthetic polypeptide
SEEAISTTNPVAYEGYGQCVCSNWGEGHNAENFISDNQS

SEQ ID NO: 209953 - protein, 40 aa, Artificial Sequence
  Description of Artificial Sequence: Synthetic polypeptide
LDNEIRTTNPVATEQWYGCAYKTIVMVHLVGDDVLINELN

SEQ ID NO: 209954 - protein, 38 aa, Artificial Sequence
  Description of Artificial Sequence: Synthetic polypeptide
DENEIRCTNPVAYEGWGQCVCSNSGEDNAEYSISDTAS

SEQ ID NO: 209955 - protein, 39 aa, Artificial Sequence
  Description of Artificial Sequence: Synthetic polypeptide
DEECISTVNPVAYEGYGQCVCSNWGEDHNAENFNSDTQA

SEQ ID NO: 209956 - protein, 40 aa, Artificial Sequence
  Description of Artificial Sequence: Synthetic polypeptide
AEAEISTTNPVATEQYGQCQVCSNSGEDHNAENFPSETQA

SEQ ID NO: 209957 - protein, 39 aa, Artificial Sequence
  Description of Artificial Sequence: Synthetic polypeptide
DEECISTTNPVAYEGYGQCVCGNWGEDHNAENFTSDNQA

SEQ ID NO: 209958 - protein, 39 aa, Artificial Sequence
  Description of Artificial Sequence: Synthetic polypeptide
SEDEIATTNPVATEQWGACIIFAGNGTGGTDSWDDNTND

SEQ ID NO: 209959 - protein, 40 aa, Artificial Sequence
  Description of Artificial Sequence: Synthetic polypeptide
AEAEISTTNPVATEQWGQCQVCSMSGEDHNAESFNSDTQA

SEQ ID NO: 209960 - protein, 39 aa, Artificial Sequence
  Description of Artificial Sequence: Synthetic polypeptide
AEAEISTTNPVATEEYGQCVCQNWGEDHNAENFISDTQS

SEQ ID NO: 209961 - protein, 38 aa, Artificial Sequence
  Description of Artificial Sequence: Synthetic polypeptide
DEASIATTNPVAYEQWGQTVTGLNPDDRQQTVQDHDKS

SEQ ID NO: 209962 - protein, 38 aa, Artificial Sequence
  Description of Artificial Sequence: Synthetic polypeptide
DEGEIACTNPVAYEQWGHCIIFAGNSGLVDNDGEHDAM

SEQ ID NO: 209963 - protein, 37 aa, Artificial Sequence
  Description of Artificial Sequence: Synthetic polypeptide
DEGEIACTNPVAYEQWGHCIIFAGNSGLVDNDSQDAE

SEQ ID NO: 209964 - protein, 40 aa, Artificial Sequence
  Description of Artificial Sequence: Synthetic polypeptide
SEAEISTVNPVATEQYGQCQVCSNWEEDHNAENFNSDTQS

SEQ ID NO: 209965 - protein, 40 aa, Artificial Sequence
  Description of Artificial Sequence: Synthetic polypeptide
AEAEISTTNPVATEGYGQCAVCSDWEEDHNAENFNSQTQI

SEQ ID NO: 209966 - protein, 40 aa, Artificial Sequence
  Description of Artificial Sequence: Synthetic polypeptide
AEAEISTTNPVATEGYGQCQVCSNSGEDHNAENFNSDNQA

SEQ ID NO: 209967 - protein, 40 aa, Artificial Sequence
  Description of Artificial Sequence: Synthetic polypeptide
AEAEISTTNPVATEGYGQCQVCSNWGEDHNAENSNSDNQS

SEQ ID NO: 209968 - protein, 39 aa, Artificial Sequence
  Description of Artificial Sequence: Synthetic polypeptide
AEAEISTTNPVATEGYGQCVCGNWGEDHNAEFFFSDTQA

SEQ ID NO: 209969 - protein, 39 aa, Artificial Sequence
  Description of Artificial Sequence: Synthetic polypeptide
AEAEISTTNPVATEGYGQCVCGNWGEDHNAENFISETQS

SEQ ID NO: 209970 - protein, 40 aa, Artificial Sequence
  Description of Artificial Sequence: Synthetic polypeptide
AEAEISTTNPVATEQWGQCQVCSNWGEDHNAENSNSENQA

SEQ ID NO: 209971 - protein, 40 aa, Artificial Sequence
  Description of Artificial Sequence: Synthetic polypeptide
HEEELVGANTNCPVITTECYGSSVCSPTFQEEVRQTVGDN

SEQ ID NO: 209972 - protein, 39 aa, Artificial Sequence
  Description of Artificial Sequence: Synthetic polypeptide
AEAEISTTNPVATEGYGQCVCGNWGEDHNAEYFNSENQA

SEQ ID NO: 209973 - protein, 39 aa, Artificial Sequence
  Description of Artificial Sequence: Synthetic polypeptide
SEAEVRTTNPVATEQYGQCVCSNWGEDHDAEYISSDTQS

SEQ ID NO: 209974 - protein, 39 aa, Artificial Sequence
  Description of Artificial Sequence: Synthetic polypeptide
ADEEISCTNPVATEQWGQCVCSNWGEDHNAESFNSDTQG

SEQ ID NO: 209975 - protein, 41 aa, Artificial Sequence
  Description of Artificial Sequence: Synthetic polypeptide
HIVHDEICTTNPVATEQYGSWCSSRVEDTQVQIPVHSEGGG

SEQ ID NO: 209976 - protein, 39 aa, Artificial Sequence
  Description of Artificial Sequence: Synthetic polypeptide
AEAEISTTNPVATEGYGQCVCSNWGEDHNAENFISDTQA

SEQ ID NO: 209977 - protein, 38 aa, Artificial Sequence
  Description of Artificial Sequence: Synthetic polypeptide
ICEQMVITVVTNNSCATECSYGSVSLSFNLEVVVDENE

SEQ ID NO: 209978 - protein, 39 aa, Artificial Sequence
  Description of Artificial Sequence: Synthetic polypeptide
AEAEISTTNPVATEGYGQCVCSNWGEDHNAENFISETQA

SEQ ID NO: 209979 - protein, 39 aa, Artificial Sequence
  Description of Artificial Sequence: Synthetic polypeptide
AEAEISTTNPVATEGYGQCVCSNWGEDHNAENFMSETQS

SEQ ID NO: 209980 - protein, 39 aa, Artificial Sequence
  Description of Artificial Sequence: Synthetic polypeptide
DEECISCTNPVAYCQYGQCVCSNWGPDHNAENFNSETQA

SEQ ID NO: 209981 - protein, 39 aa, Artificial Sequence
  Description of Artificial Sequence: Synthetic polypeptide
EEVEIATTNPVAYEQWGHIQVGRPTEGGRQIEQQQGQGH

SEQ ID NO: 209982 - protein, 38 aa, Artificial Sequence
  Description of Artificial Sequence: Synthetic polypeptide
CEEVIACTNPVATEQYGCINPAANEHPEAGGPQDEAAW

SEQ ID NO: 209983 - protein, 39 aa, Artificial Sequence
  Description of Artificial Sequence: Synthetic polypeptide
AEAAISTTNPVATEGYGQCVCSNSGEDHNAENFISDNQA

SEQ ID NO: 209984 - protein, 39 aa, Artificial Sequence
  Description of Artificial Sequence: Synthetic polypeptide
DEDEIATTNPVAYEPWGRPPPTAGQGPMLQEHQDGMEAW

SEQ ID NO: 209985 - protein, 38 aa, Artificial Sequence
  Description of Artificial Sequence: Synthetic polypeptide
DSSEVASTNPVSYEPYGNVVAANATAISQMNTGGQNRL

SEQ ID NO: 209986 - protein, 39 aa, Artificial Sequence
  Description of Artificial Sequence: Synthetic polypeptide
DENEISTTNPVAYEGWGQCVTSNWGADENAEYFNSDNAA

SEQ ID NO: 209987 - protein, 38 aa, Artificial Sequence
  Description of Artificial Sequence: Synthetic polypeptide
DDACISTTNPVAYEQYGQCVCSNWGEHNAENFISDTQA

SEQ ID NO: 209988 - protein, 39 aa, Artificial Sequence
  Description of Artificial Sequence: Synthetic polypeptide
DDACISTTNPVAYEQYGQCVCSNWGEGHNAENFNSDNAA

SEQ ID NO: 209989 - protein, 39 aa, Artificial Sequence
  Description of Artificial Sequence: Synthetic polypeptide
DENEISTTNPVAYEGWGQCVTSNSMEDENAEYFNSDTAA

SEQ ID NO: 209990 - protein, 39 aa, Artificial Sequence
  Description of Artificial Sequence: Synthetic polypeptide
DDACISTTNPVAYEQYGQCVCSNWGEDPNAENFNSDPQA

SEQ ID NO: 209991 - protein, 39 aa, Artificial Sequence
  Description of Artificial Sequence: Synthetic polypeptide
DDACISTTNPVAYEQYGQCVCSNWGEDHNIENFGSDTQS

SEQ ID NO: 209992 - protein, 39 aa, Artificial Sequence
  Description of Artificial Sequence: Synthetic polypeptide
DDACISTTNPVAYEQYGQCVCSNWGEDHNAEYFNSDNQG

SEQ ID NO: 209993 - protein, 39 aa, Artificial Sequence
  Description of Artificial Sequence: Synthetic polypeptide
DDACISTTNPVAYEQYGQCVCSNWGEDHNAENFGSDTQA

SEQ ID NO: 209994 - protein, 39 aa, Artificial Sequence
  Description of Artificial Sequence: Synthetic polypeptide
DDACISTTNPVAYEQYGQCVCSNWGEDHNAEGFNSDTQS

SEQ ID NO: 209995 - protein, 39 aa, Artificial Sequence
  Description of Artificial Sequence: Synthetic polypeptide
DDACISTTNPVAYEQYGQCVCSNWGEDHNAEGFDSDNQL

SEQ ID NO: 209996 - protein, 39 aa, Artificial Sequence
  Description of Artificial Sequence: Synthetic polypeptide
DEAAIGTTNPVAYEGYGQCVCGTWGEDHNTENFISDNAS

SEQ ID NO: 209997 - protein, 39 aa, Artificial Sequence
  Description of Artificial Sequence: Synthetic polypeptide
DDACISTTNPVAYEQYGQCVCSNWEADHNAENFTSDNQS

SEQ ID NO: 209998 - protein, 38 aa, Artificial Sequence
  Description of Artificial Sequence: Synthetic polypeptide
DDACISTTNPVAYEQYGQCVCSMWEEHNAENFISDTQA

SEQ ID NO: 209999 - protein, 38 aa, Artificial Sequence
  Description of Artificial Sequence: Synthetic polypeptide
DDACISTTNPVAYEGYGQCVCSWGEDPNAENFNSETQS

SEQ ID NO: 210000 - protein, 39 aa, Artificial Sequence
  Description of Artificial Sequence: Synthetic polypeptide
DDACISTTNPVAYEGYGQCVCSTWGEDPNAEHFNSETQA

SEQ ID NO: 210001 - protein, 39 aa, Artificial Sequence
  Description of Artificial Sequence: Synthetic polypeptide
DEAAIGTTNPVAYEGYGQCVCSNWGEDHNTENFNSDTAS

SEQ ID NO: 210002 - protein, 38 aa, Artificial Sequence
  Description of Artificial Sequence: Synthetic polypeptide
AEEAISTTNPVAYEAYGCVCGNWGEDHNAENFNSDPQA

SEQ ID NO: 210003 - protein, 38 aa, Artificial Sequence
  Description of Artificial Sequence: Synthetic polypeptide
DETEIACTNPVAYEMPYGNTTGTAPAEGTATQQDENAD

SEQ ID NO: 210004 - protein, 37 aa, Artificial Sequence
  Description of Artificial Sequence: Synthetic polypeptide
DETEIACTNPVAYEQWGHCIFAGAENGNDAAAAAGMH

SEQ ID NO: 210005 - protein, 41 aa, Artificial Sequence
  Description of Artificial Sequence: Synthetic polypeptide
TEEWAIQRGTNPVCSYEQYGQSIPSCLGGMLSIRTVGNMFV

SEQ ID NO: 210006 - protein, 39 aa, Artificial Sequence
  Description of Artificial Sequence: Synthetic polypeptide
DDACISTTNPVAYEQYGQCVCSNWMEAHNAENFNSETQA

SEQ ID NO: 210007 - protein, 38 aa, Artificial Sequence
  Description of Artificial Sequence: Synthetic polypeptide
AEEAISTTNPVAYEGYGCVCGNWGEDHNAEHFNSDTQS

SEQ ID NO: 210008 - protein, 40 aa, Artificial Sequence
  Description of Artificial Sequence: Synthetic polypeptide
DENEISTTNPVAYEGYGQCAVCSNWEEDHNAENFNSDFQS

SEQ ID NO: 210009 - protein, 39 aa, Artificial Sequence
  Description of Artificial Sequence: Synthetic polypeptide
DESTIRTTNCVATEAYGAAGNGANDENDGEQQGGMEGAQ

SEQ ID NO: 210010 - protein, 39 aa, Artificial Sequence
  Description of Artificial Sequence: Synthetic polypeptide
DEMEISCTNPVAYEGYGQCVCSNWGEDHNAENFISENQL

SEQ ID NO: 210011 - protein, 39 aa, Artificial Sequence
  Description of Artificial Sequence: Synthetic polypeptide
AETCIRTTNPLATEQFGQCVCSNWGEDDNAESFGSDTQS

SEQ ID NO: 210012 - protein, 37 aa, Artificial Sequence
  Description of Artificial Sequence: Synthetic polypeptide
TENEISTTNPVSYEGYGCICSNWEEDNAEQFISDTQS

SEQ ID NO: 210013 - protein, 39 aa, Artificial Sequence
  Description of Artificial Sequence: Synthetic polypeptide
DEACISCTNPVATCQYGQCVCSNWGEDHNAENFNSDTQS

SEQ ID NO: 210014 - protein, 39 aa, Artificial Sequence
  Description of Artificial Sequence: Synthetic polypeptide
DAQQIATTNPVAYEQWGHSPICAMTAGIGIATGDDNGRP

SEQ ID NO: 210015 - protein, 37 aa, Artificial Sequence
  Description of Artificial Sequence: Synthetic polypeptide
DDSEVACTNPVSTEGYGQCVCGTWGEHNAENFGSQQA

SEQ ID NO: 210016 - protein, 37 aa, Artificial Sequence
  Description of Artificial Sequence: Synthetic polypeptide
DAQQIATTNPVAYEQWGSICAMTAGIGIATGGDIGEP

SEQ ID NO: 210017 - protein, 40 aa, Artificial Sequence
  Description of Artificial Sequence: Synthetic polypeptide
DEMEISCTNPVATEGYGQCQVCQNWGEDHNAEGFNSDTQS

SEQ ID NO: 210018 - protein, 38 aa, Artificial Sequence
  Description of Artificial Sequence: Synthetic polypeptide
DETEIATTNPCATEGWGCQTCGNWEEHNAEYSGSETQA

SEQ ID NO: 210019 - protein, 38 aa, Artificial Sequence
  Description of Artificial Sequence: Synthetic polypeptide
DENEISTTNPVSTEGYGCICSNWEEDHNAENFISDTQS

SEQ ID NO: 210020 - protein, 39 aa, Artificial Sequence
  Description of Artificial Sequence: Synthetic polypeptide
DEACIRTTNPVAYEGYGQCVCGNWGEDHNAENFNSDTQA

SEQ ID NO: 210021 - protein, 39 aa, Artificial Sequence
  Description of Artificial Sequence: Synthetic polypeptide
DENEISTTNPVAYEQWGQCVCSNSGEDDNAEYSISDTAS

SEQ ID NO: 210022 - protein, 39 aa, Artificial Sequence
  Description of Artificial Sequence: Synthetic polypeptide
DENEISTTNPVAYEQWGICVCSNSGEDDNAEYSSSDTAA

SEQ ID NO: 210023 - protein, 39 aa, Artificial Sequence
  Description of Artificial Sequence: Synthetic polypeptide
AEEAISTTNPVAYEGYGQCVCENWGEDDNQENFNSDTQS

SEQ ID NO: 210024 - protein, 39 aa, Artificial Sequence
  Description of Artificial Sequence: Synthetic polypeptide
DENEISTTNPVAYEGYGQCVCSNWEEDHNAENFISDTQA

SEQ ID NO: 210025 - protein, 39 aa, Artificial Sequence
  Description of Artificial Sequence: Synthetic polypeptide
DENEISTTNPVAYEGYGQCVCSNSGEDHNAENFPSDTQP

SEQ ID NO: 210026 - protein, 39 aa, Artificial Sequence
  Description of Artificial Sequence: Synthetic polypeptide
DENEISTTNPVAYEGYGQCVCSNSGEDHNAENFISDTQA

SEQ ID NO: 210027 - protein, 38 aa, Artificial Sequence
  Description of Artificial Sequence: Synthetic polypeptide
DEEEIRTTNPCYYYADPPWGSTAACADEGNQAAEGGME

SEQ ID NO: 210028 - protein, 40 aa, Artificial Sequence
  Description of Artificial Sequence: Synthetic polypeptide
DDAEIGTTNPVAYEQYGQCQVCSNWGPDHNAENFNSDPQS

SEQ ID NO: 210029 - protein, 39 aa, Artificial Sequence
  Description of Artificial Sequence: Synthetic polypeptide
AENEIACTNPVATEQYGQCSCSNWGEDDNQEYFSSDTQA

SEQ ID NO: 210030 - protein, 39 aa, Artificial Sequence
  Description of Artificial Sequence: Synthetic polypeptide
DEMEISCTNPVAYEGYGQCVCSNWGEDHNAENFNSDNQG

SEQ ID NO: 210031 - protein, 37 aa, Artificial Sequence
  Description of Artificial Sequence: Synthetic polypeptide
DEVEIATTNPVAYAPWGSTTAGGEHAGVATAGGPNGF

SEQ ID NO: 210032 - protein, 37 aa, Artificial Sequence
  Description of Artificial Sequence: Synthetic polypeptide
DETEIATTNPCAYAPWGATTSANATDGPAEPKGPQNV

SEQ ID NO: 210033 - protein, 40 aa, Artificial Sequence
  Description of Artificial Sequence: Synthetic polypeptide
SEEEISTVNPVAYEGYGQCQVCSTWGEDHNAENFNSDTQA

SEQ ID NO: 210034 - protein, 38 aa, Artificial Sequence
  Description of Artificial Sequence: Synthetic polypeptide
DDACISTTNPVATEHYGQCVCGNWGEHNAENFISDTQN

SEQ ID NO: 210035 - protein, 38 aa, Artificial Sequence
  Description of Artificial Sequence: Synthetic polypeptide
DETEIATTNPIATECWGATYYANENDHQHTEKTGKGMS

SEQ ID NO: 210036 - protein, 38 aa, Artificial Sequence
  Description of Artificial Sequence: Synthetic polypeptide
DETEIATTNPIATECWGATYYANENDHQLHDKHGKGPS

SEQ ID NO: 210037 - protein, 38 aa, Artificial Sequence
  Description of Artificial Sequence: Synthetic polypeptide
DETEIATTNPIATECWGATYYANENDHQLHDKTGGGMS

SEQ ID NO: 210038 - protein, 38 aa, Artificial Sequence
  Description of Artificial Sequence: Synthetic polypeptide
DETEIATTNPIATECWGATYYANENDHQLHEKTGKGTS

SEQ ID NO: 210039 - protein, 39 aa, Artificial Sequence
  Description of Artificial Sequence: Synthetic polypeptide
DDACISTTNPVATEGYGQCVCSNWMPDHNAENFNSDTQS

SEQ ID NO: 210040 - protein, 37 aa, Artificial Sequence
  Description of Artificial Sequence: Synthetic polypeptide
DETSIAPTNPIAYEPVGIVNTNAVAEDQAEGGTVPAI

SEQ ID NO: 210041 - protein, 38 aa, Artificial Sequence
  Description of Artificial Sequence: Synthetic polypeptide
DETEIATTNPIATECWGATYYANENDHQLHEKTMMGMS

SEQ ID NO: 210042 - protein, 39 aa, Artificial Sequence
  Description of Artificial Sequence: Synthetic polypeptide
AEEAISTTNPVATEGYGQCVCSNWEEDHNAENFISDTQS

SEQ ID NO: 210043 - protein, 39 aa, Artificial Sequence
  Description of Artificial Sequence: Synthetic polypeptide
AEEAISTTNPVATEGYGQCVCGNWGEDDNAENFNSDTQA

SEQ ID NO: 210044 - protein, 38 aa, Artificial Sequence
  Description of Artificial Sequence: Synthetic polypeptide
DETEIATTNPIATECWGATYYANENDHQVHDKNGKGMS

SEQ ID NO: 210045 - protein, 39 aa, Artificial Sequence
  Description of Artificial Sequence: Synthetic polypeptide
DDACISTTNPVATEGYGQCVCSNWGEDHNAEYFNSDTQS

SEQ ID NO: 210046 - protein, 39 aa, Artificial Sequence
  Description of Artificial Sequence: Synthetic polypeptide
DDACISTTNPVATEGYGQCVCSNWGEDHNAENFISDNQN

SEQ ID NO: 210047 - protein, 39 aa, Artificial Sequence
  Description of Artificial Sequence: Synthetic polypeptide
DDACISTTNPVATEGYGQCVCSNWGEDDNIEHFNSDTQA

SEQ ID NO: 210048 - protein, 40 aa, Artificial Sequence
  Description of Artificial Sequence: Synthetic polypeptide
AEEAISTTNPVATEGYGQCIVCSNWGEDDNAENFNSDTQA

SEQ ID NO: 210049 - protein, 38 aa, Artificial Sequence
  Description of Artificial Sequence: Synthetic polypeptide
CEDEIATTNPVAYYEEAPAYVETAAMANDQVSNHTPHT

SEQ ID NO: 210050 - protein, 40 aa, Artificial Sequence
  Description of Artificial Sequence: Synthetic polypeptide
AEEAIRTTNPVAYEGYGQCQVCSNWGYDHNTEGFNSENQA

SEQ ID NO: 210051 - protein, 38 aa, Artificial Sequence
  Description of Artificial Sequence: Synthetic polypeptide
CEDEIATTNPVAYQMPYGHSPTPAANNGETGTQGGSFE

SEQ ID NO: 210052 - protein, 39 aa, Artificial Sequence
  Description of Artificial Sequence: Synthetic polypeptide
SEEEISTTNPVAYEGYGQCVCGNWGEDHNIEYFNSETQA

SEQ ID NO: 210053 - protein, 37 aa, Artificial Sequence
  Description of Artificial Sequence: Synthetic polypeptide
DETEIATTNPIATECWGATTYANATDGPAEPKGSPQN

SEQ ID NO: 210054 - protein, 40 aa, Artificial Sequence
  Description of Artificial Sequence: Synthetic polypeptide
SEEEISTTNPVAYEGYGQCIVCSNWGEDHNTENFNSETQS

SEQ ID NO: 210055 - protein, 40 aa, Artificial Sequence
  Description of Artificial Sequence: Synthetic polypeptide
SEEEISTTNPVAYEGYGQCAVCSNWGEDHNAEYFNSENQA

SEQ ID NO: 210056 - protein, 38 aa, Artificial Sequence
  Description of Artificial Sequence: Synthetic polypeptide
DDACISTTNPVAYEGYGCVCSNWGEDPNAENFNSDTQS

SEQ ID NO: 210057 - protein, 38 aa, Artificial Sequence
  Description of Artificial Sequence: Synthetic polypeptide
DDACISTTNPVAYEGYGCVCSNWGEDDNAENFNSETQN

SEQ ID NO: 210058 - protein, 38 aa, Artificial Sequence
  Description of Artificial Sequence: Synthetic polypeptide
DDACISTTNPVAYEGYGCVCSMWEEDHNAENFNSDTQA

SEQ ID NO: 210059 - protein, 36 aa, Artificial Sequence
  Description of Artificial Sequence: Synthetic polypeptide
DETEIATTNPCAYAPWGATTVALATDGPAEPKGPEN

SEQ ID NO: 210060 - protein, 39 aa, Artificial Sequence
  Description of Artificial Sequence: Synthetic polypeptide
AENEIATTNPVATEGYGQCVCSNWGEADNQEHFISETQA

SEQ ID NO: 210061 - protein, 37 aa, Artificial Sequence
  Description of Artificial Sequence: Synthetic polypeptide
DETEIATTNPCAYAPWGATTVANNTDGPAEPKGPQND

SEQ ID NO: 210062 - protein, 36 aa, Artificial Sequence
  Description of Artificial Sequence: Synthetic polypeptide
DETEIATTNPCAYEPWGATTTAGATDGPAEPKGPEN

SEQ ID NO: 210063 - protein, 38 aa, Artificial Sequence
  Description of Artificial Sequence: Synthetic polypeptide
DDACISTTNPVAYCQYGCVCSNWGEDHNAENFNSDNQA

SEQ ID NO: 210064 - protein, 38 aa, Artificial Sequence
  Description of Artificial Sequence: Synthetic polypeptide
QEEEIATTNPVAYEWYGEHAPWCEHEFSHSHAEGEMWC

SEQ ID NO: 210065 - protein, 38 aa, Artificial Sequence
  Description of Artificial Sequence: Synthetic polypeptide
DDACISTTNPVAYEGYGCVCSNWMEDHNAENFNSETQA

SEQ ID NO: 210066 - protein, 38 aa, Artificial Sequence
  Description of Artificial Sequence: Synthetic polypeptide
DETEIATTNPIATECWGAATTSANATDGPAEPKGTPEN

SEQ ID NO: 210067 - protein, 38 aa, Artificial Sequence
  Description of Artificial Sequence: Synthetic polypeptide
AENEIATTNPVAYEGYGCVCSNWGEDDNTEHFISETQA

SEQ ID NO: 210068 - protein, 37 aa, Artificial Sequence
  Description of Artificial Sequence: Synthetic polypeptide
DETEIATTNPIATECWGATTNAGATDGPAEPKGSPSN

SEQ ID NO: 210069 - protein, 39 aa, Artificial Sequence
  Description of Artificial Sequence: Synthetic polypeptide
SEEEISCTNPVAYEGYGQCVCSNSGEDHNAEYFNSDTQA

SEQ ID NO: 210070 - protein, 36 aa, Artificial Sequence
  Description of Artificial Sequence: Synthetic polypeptide
DETEIATTNPIATECWGATTQACAEDHAEPTGGPYI

SEQ ID NO: 210071 - protein, 38 aa, Artificial Sequence
  Description of Artificial Sequence: Synthetic polypeptide
AENEIATTNPVAYEGYGQCVCSNWGEDNAEHFISETQA

SEQ ID NO: 210072 - protein, 39 aa, Artificial Sequence
  Description of Artificial Sequence: Synthetic polypeptide
DDACISTTNPVATEQYGQCVCSNWEEDHNAEFFISDTQN

SEQ ID NO: 210073 - protein, 39 aa, Artificial Sequence
  Description of Artificial Sequence: Synthetic polypeptide
DDACISTTNPVATEQYGQCVCQNWGYDHNAENFNSDTQA

SEQ ID NO: 210074 - protein, 36 aa, Artificial Sequence
  Description of Artificial Sequence: Synthetic polypeptide
DETEIATTNPIATECWGATTWAGAEDPAEPKGSPYP

SEQ ID NO: 210075 - protein, 38 aa, Artificial Sequence
  Description of Artificial Sequence: Synthetic polypeptide
DETEIATTNPIATECWGATTWANATDGPAEPKGTPYNP

SEQ ID NO: 210076 - protein, 39 aa, Artificial Sequence
  Description of Artificial Sequence: Synthetic polypeptide
SEEEISCTNPCAYEQYGQCVCSNWEEDHNAEGFNSDTQS

SEQ ID NO: 210077 - protein, 39 aa, Artificial Sequence
  Description of Artificial Sequence: Synthetic polypeptide
DEAAIGTTNPVAYCGYGQCVCSTWGEDHNTENFNSDNAS

SEQ ID NO: 210078 - protein, 39 aa, Artificial Sequence
  Description of Artificial Sequence: Synthetic polypeptide
DEACISCTNPVATEGYGQCVCSNSEEDHNAENFNSDTQF

SEQ ID NO: 210079 - protein, 39 aa, Artificial Sequence
  Description of Artificial Sequence: Synthetic polypeptide
DEACISCTNPVATEGYGQCVCSNWGEDHNAENFISENQL

SEQ ID NO: 210080 - protein, 39 aa, Artificial Sequence
  Description of Artificial Sequence: Synthetic polypeptide
DEACISTTNPCAYEQYGQCVCSNWGEDHNAENFNSDNAP

SEQ ID NO: 210081 - protein, 40 aa, Artificial Sequence
  Description of Artificial Sequence: Synthetic polypeptide
CEEEISTTNPVATEQWGQCASCQNWGEDHNAENFNSDTQS

SEQ ID NO: 210082 - protein, 38 aa, Artificial Sequence
  Description of Artificial Sequence: Synthetic polypeptide
TSQEIGTTNPVCYEQYGCTTICCTGEDSEQSTVINNRD

SEQ ID NO: 210083 - protein, 39 aa, Artificial Sequence
  Description of Artificial Sequence: Synthetic polypeptide
DDRCISTTNPVAYEEYGQCVCSNWGEDHNTENFNSDNQA

SEQ ID NO: 210084 - protein, 39 aa, Artificial Sequence
  Description of Artificial Sequence: Synthetic polypeptide
DDREISTTNPVAYEEYGQCVCQNWNEGTNAENFNSETQS

SEQ ID NO: 210085 - protein, 37 aa, Artificial Sequence
  Description of Artificial Sequence: Synthetic polypeptide
DDSAVACTNPVSTEGYGCVCQTWGEHNAEYFGSQNQS

SEQ ID NO: 210086 - protein, 37 aa, Artificial Sequence
  Description of Artificial Sequence: Synthetic polypeptide
TSQEIGTTNPVCYEQYGCTTICCTDEDSGQSTVIQRD

SEQ ID NO: 210087 - protein, 38 aa, Artificial Sequence
  Description of Artificial Sequence: Synthetic polypeptide
TSQEIGTTNPVCYEQYGCTTICCLNEWSGQSTVINNRD

SEQ ID NO: 210088 - protein, 40 aa, Artificial Sequence
  Description of Artificial Sequence: Synthetic polypeptide
DESEIRTTNCVATEAYGAAGNGAGDANDGEQQGGMEGGQN

SEQ ID NO: 210089 - protein, 39 aa, Artificial Sequence
  Description of Artificial Sequence: Synthetic polypeptide
DESEIRTTNCVATEAYGAAGNGAGDDADGEQQGGMEGGA

SEQ ID NO: 210090 - protein, 39 aa, Artificial Sequence
  Description of Artificial Sequence: Synthetic polypeptide
DESEIRTTNCVATEAYGAAGNGAGDDADGEQTGGMEGAQ

SEQ ID NO: 210091 - protein, 40 aa, Artificial Sequence
  Description of Artificial Sequence: Synthetic polypeptide
DESEIRTTNCVATEAYGAAGNGAGDDNDGEQQGGQEGAQG

SEQ ID NO: 210092 - protein, 40 aa, Artificial Sequence
  Description of Artificial Sequence: Synthetic polypeptide
DESEIRTTNCVATEAYGAAGNGAGDDNDGEQQGIMEGAQQ

SEQ ID NO: 210093 - protein, 39 aa, Artificial Sequence
  Description of Artificial Sequence: Synthetic polypeptide
DEACISTTNPCATEGYGQCVCYNSGEDHNIENFLSDTQS

SEQ ID NO: 210094 - protein, 38 aa, Artificial Sequence
  Description of Artificial Sequence: Synthetic polypeptide
DEQEIATTNPIATECWGATYYGNENDHQLHEKTGKGMS

SEQ ID NO: 210095 - protein, 40 aa, Artificial Sequence
  Description of Artificial Sequence: Synthetic polypeptide
DDAEISTTNPVATEQYGQCQVCSNWGEDHNAENFISDTQA

SEQ ID NO: 210096 - protein, 39 aa, Artificial Sequence
  Description of Artificial Sequence: Synthetic polypeptide
DEACISCTNPVAYEQYGQCVCSNWMEDHNAENFNSDTQI

SEQ ID NO: 210097 - protein, 39 aa, Artificial Sequence
  Description of Artificial Sequence: Synthetic polypeptide
DEACISCTNPVAYEQYGQCVCSNWGEDHNAEGFNSDNQS

SEQ ID NO: 210098 - protein, 39 aa, Artificial Sequence
  Description of Artificial Sequence: Synthetic polypeptide
DEEEISCTNPVAYEGYGQCQICSNWEEHNIEFFNSDTQQ

SEQ ID NO: 210099 - protein, 36 aa, Artificial Sequence
  Description of Artificial Sequence: Synthetic polypeptide
QENEIATTNPCAYAPWGNTVAGEGHLQNHQMNMFKV

SEQ ID NO: 210100 - protein, 38 aa, Artificial Sequence
  Description of Artificial Sequence: Synthetic polypeptide
TSQEIGTTNPVCYEQYGCTTICCTPEDSGQSTVPNNRD

SEQ ID NO: 210101 - protein, 39 aa, Artificial Sequence
  Description of Artificial Sequence: Synthetic polypeptide
TSQEIGTTNPVCYEQYGCTTICCTTNEDSGQSTVLNNRD

SEQ ID NO: 210102 - protein, 38 aa, Artificial Sequence
  Description of Artificial Sequence: Synthetic polypeptide
TSQEIGTTNPVCYEQYGCTTYCCENEDSGQSTVINNRD

SEQ ID NO: 210103 - protein, 39 aa, Artificial Sequence
  Description of Artificial Sequence: Synthetic polypeptide
DEACISTTNPVATEGYGQCVCSNWEEDHNTESFISETQS

SEQ ID NO: 210104 - protein, 39 aa, Artificial Sequence
  Description of Artificial Sequence: Synthetic polypeptide
DDAEISTTNPVAYEGYGICVCSNWEEDHNAEHFNSETQA

SEQ ID NO: 210105 - protein, 39 aa, Artificial Sequence
  Description of Artificial Sequence: Synthetic polypeptide
DEACISTTNPVATEGYGQCVCPNWGEDHNAEGFISETQA

SEQ ID NO: 210106 - protein, 39 aa, Artificial Sequence
  Description of Artificial Sequence: Synthetic polypeptide
DEACISTTNPVATEGYGQCVCGNWGEDHNAENFTSDNQS

SEQ ID NO: 210107 - protein, 38 aa, Artificial Sequence
  Description of Artificial Sequence: Synthetic polypeptide
VEDEIACTNPVATEQWGCIITAATPNVDAPMTPNGHHM

SEQ ID NO: 210108 - protein, 37 aa, Artificial Sequence
  Description of Artificial Sequence: Synthetic polypeptide
VEDEIACTNPVATEQWGCIIAAGNNATAMAPMQDNQW

SEQ ID NO: 210109 - protein, 40 aa, Artificial Sequence
  Description of Artificial Sequence: Synthetic polypeptide
DEACISTTNPVATEGYGQCQVCSNWGYDHNTEGFNSENQS

SEQ ID NO: 210110 - protein, 40 aa, Artificial Sequence
  Description of Artificial Sequence: Synthetic polypeptide
DEACISTTNPVATEGYGQCQVCSNWGEDHNAEGFNSDTQS

SEQ ID NO: 210111 - protein, 40 aa, Artificial Sequence
  Description of Artificial Sequence: Synthetic polypeptide
DEACISTTNPVATEGYGQCQVCQNSGEDDNTEYFNSENQS

SEQ ID NO: 210112 - protein, 39 aa, Artificial Sequence
  Description of Artificial Sequence: Synthetic polypeptide
DEEEISCTNPVAYEGYGQCVCPNWGEDHNAEYFNSDNQS

SEQ ID NO: 210113 - protein, 37 aa, Artificial Sequence
  Description of Artificial Sequence: Synthetic polypeptide
DSAEISTTNPVGYEQWGCVCSNWGEHNAENFISVTQS

SEQ ID NO: 210114 - protein, 39 aa, Artificial Sequence
  Description of Artificial Sequence: Synthetic polypeptide
DDAEISTTNPVAYEGYGCAVCSNWGEDDNAENFNSDNQS

SEQ ID NO: 210115 - protein, 40 aa, Artificial Sequence
  Description of Artificial Sequence: Synthetic polypeptide
DEACISTTNPVATEGYGQCAVCSNWGEGDNAENFNSDNQS

SEQ ID NO: 210116 - protein, 38 aa, Artificial Sequence
  Description of Artificial Sequence: Synthetic polypeptide
CAEEIATTNPVAYEQWGQNVCAMNNGGEPDIGGDIEMW

SEQ ID NO: 210117 - protein, 39 aa, Artificial Sequence
  Description of Artificial Sequence: Synthetic polypeptide
DDAEISTTNPVAYEEYGQCVCSNWGEADNAEGFNSETQS

SEQ ID NO: 210118 - protein, 39 aa, Artificial Sequence
  Description of Artificial Sequence: Synthetic polypeptide
DDAEISTTNPVAYEEYGQCVCSNSGEDHNAEHFISDNQF

SEQ ID NO: 210119 - protein, 37 aa, Artificial Sequence
  Description of Artificial Sequence: Synthetic polypeptide
CAEEIATTNPVAYASWGTCFAGTAGQLPWNRMDDNEW

SEQ ID NO: 210120 - protein, 40 aa, Artificial Sequence
  Description of Artificial Sequence: Synthetic polypeptide
DEQEIATTNPVATEQWGCTNNQANGNGVDTATANIDEETP

SEQ ID NO: 210121 - protein, 37 aa, Artificial Sequence
  Description of Artificial Sequence: Synthetic polypeptide
TSSEVASTNPVSYEPYGNVVAANATISQISTGLQNRL

SEQ ID NO: 210122 - protein, 39 aa, Artificial Sequence
  Description of Artificial Sequence: Synthetic polypeptide
TSQEIGTTNPVCYEQYGTCTTICCTNEDSGQSTVQNNRD

SEQ ID NO: 210123 - protein, 40 aa, Artificial Sequence
  Description of Artificial Sequence: Synthetic polypeptide
DEACISTTNPVATEGYGQCQVCGNSGEDDNTENFNSETQA

SEQ ID NO: 210124 - protein, 39 aa, Artificial Sequence
  Description of Artificial Sequence: Synthetic polypeptide
DEEEISCTNPVAYEGYGQCVCQNWGEDDNIENFNSENQA

SEQ ID NO: 210125 - protein, 39 aa, Artificial Sequence
  Description of Artificial Sequence: Synthetic polypeptide
DQAEISTTNPVAYEQYGQCCCSNWGEDHNAEHFNSDTQA

SEQ ID NO: 210126 - protein, 39 aa, Artificial Sequence
  Description of Artificial Sequence: Synthetic polypeptide
DQAEISTTNPVATEQYGQCCCGNWGEDHNAEHFISDTQA

SEQ ID NO: 210127 - protein, 39 aa, Artificial Sequence
  Description of Artificial Sequence: Synthetic polypeptide
DDAEISCTNPVAYEQYGQCVCSNWGEDDNAEHFNSDTQA

SEQ ID NO: 210128 - protein, 34 aa, Artificial Sequence
  Description of Artificial Sequence: Synthetic polypeptide
QEGEIASTNPCSYEQWGMTCYCNDQQDQSHQTLS

SEQ ID NO: 210129 - protein, 38 aa, Artificial Sequence
  Description of Artificial Sequence: Synthetic polypeptide
SENEIATTNPVAYEGYGQCVCSNWGEHNAEHFSSETQA

SEQ ID NO: 210130 - protein, 39 aa, Artificial Sequence
  Description of Artificial Sequence: Synthetic polypeptide
DDAEISCTNPVAYEQYGQCVCSNWEEDHNAEHFNSETQA

SEQ ID NO: 210131 - protein, 33 aa, Artificial Sequence
  Description of Artificial Sequence: Synthetic polypeptide
DDSEVASTNPISTEGWGATTAAATIQSPKGQYI

SEQ ID NO: 210132 - protein, 40 aa, Artificial Sequence
  Description of Artificial Sequence: Synthetic polypeptide
DEEEISTTNPVAYEGYGQCQVCSNWGEDHNAENFISETQA

SEQ ID NO: 210133 - protein, 39 aa, Artificial Sequence
  Description of Artificial Sequence: Synthetic polypeptide
DEAAIGCTNPVAYEGYGQCVCSNWGEDHNTENFNSDNQA

SEQ ID NO: 210134 - protein, 40 aa, Artificial Sequence
  Description of Artificial Sequence: Synthetic polypeptide
DEEEISTTNPVAYEGYGQCQVCQNWGEDHNIENFNSQNQG

SEQ ID NO: 210135 - protein, 40 aa, Artificial Sequence
  Description of Artificial Sequence: Synthetic polypeptide
DEEEISTTNPVAYEGYGQCQVCENWGEDHNAENFISDNQS

SEQ ID NO: 210136 - protein, 39 aa, Artificial Sequence
  Description of Artificial Sequence: Synthetic polypeptide
DDAEISCTNPVAYEQYGQCVCSNWGEDHNAENFISDNQG

SEQ ID NO: 210137 - protein, 39 aa, Artificial Sequence
  Description of Artificial Sequence: Synthetic polypeptide
DDAEISCTNPVATEEYGQCVCSNSGEDHNAEYFNSDNQS

SEQ ID NO: 210138 - protein, 39 aa, Artificial Sequence
  Description of Artificial Sequence: Synthetic polypeptide
DEEEIATTNPVAYAQWGGCTIFAGNNGDTTANQGGDQMQ

SEQ ID NO: 210139 - protein, 36 aa, Artificial Sequence
  Description of Artificial Sequence: Synthetic polypeptide
TESEICTTNPVAYGPYGQSSQSCWSASSMSIVTSEE

SEQ ID NO: 210140 - protein, 39 aa, Artificial Sequence
  Description of Artificial Sequence: Synthetic polypeptide
DEAAIGCTNPVAYEQWGQCVCSNWGEDHNTENFISDNAS

SEQ ID NO: 210141 - protein, 36 aa, Artificial Sequence
  Description of Artificial Sequence: Synthetic polypeptide
DDSEVACTNPVSYEGYGCVCGTWEHNQEYFGSQTQA

SEQ ID NO: 210142 - protein, 40 aa, Artificial Sequence
  Description of Artificial Sequence: Synthetic polypeptide
DEAAIGCTNPVAYEQYGQCQVCSNWGEDHNTENFNSDNQS

SEQ ID NO: 210143 - protein, 39 aa, Artificial Sequence
  Description of Artificial Sequence: Synthetic polypeptide
AEEAISTTNPVAYEGYGQCVCSNWMEDHNAEGFNSDNQF

SEQ ID NO: 210144 - protein, 40 aa, Artificial Sequence
  Description of Artificial Sequence: Synthetic polypeptide
DEACISCTNPVATEQYGQCQVCSNWEEDHNAENFNSDNAA

SEQ ID NO: 210145 - protein, 38 aa, Artificial Sequence
  Description of Artificial Sequence: Synthetic polypeptide
DEMEISTTNPCATEGWGCQTCFNAEEDNAEHSGSDNQS

SEQ ID NO: 210146 - protein, 40 aa, Artificial Sequence
  Description of Artificial Sequence: Synthetic polypeptide
DEMEISCTNPVAYEQYGQCAVCSNWMEDHNAENFPSENQS

SEQ ID NO: 210147 - protein, 39 aa, Artificial Sequence
  Description of Artificial Sequence: Synthetic polypeptide
DEEEISTTNPVAYEGWGQCVCQNWGEDHNAENFISDTQS

SEQ ID NO: 210148 - protein, 38 aa, Artificial Sequence
  Description of Artificial Sequence: Synthetic polypeptide
DETEIATTNPIATECWGATYYANENEHDLHEKTGKGMS

SEQ ID NO: 210149 - protein, 39 aa, Artificial Sequence
  Description of Artificial Sequence: Synthetic polypeptide
DDAEISCTNPVAYEQYGQCVCSNWGEDPNAENFNSDTQS

SEQ ID NO: 210150 - protein, 36 aa, Artificial Sequence
  Description of Artificial Sequence: Synthetic polypeptide
TETEIRTTNPIAYECWGQATTPACAEHWAEPTGTPI

SEQ ID NO: 210151 - protein, 39 aa, Artificial Sequence
  Description of Artificial Sequence: Synthetic polypeptide
DDAEISTTNPVATEGYGQCVCVNWGEDHNAENFNSDTQA

SEQ ID NO: 210152 - protein, 39 aa, Artificial Sequence
  Description of Artificial Sequence: Synthetic polypeptide
DDAEISTTNPVATEGYGQCVCSNWGEDHNQENFISDTQP

SEQ ID NO: 210153 - protein, 39 aa, Artificial Sequence
  Description of Artificial Sequence: Synthetic polypeptide
DDAEISTTNPVATEGYGQCVCSNWGEDHNIENFISQTQA

SEQ ID NO: 210154 - protein, 40 aa, Artificial Sequence
  Description of Artificial Sequence: Synthetic polypeptide
AEECIGTTNPVAYEEYGQCQSCSNWGEDHNTENSNSDNQA

SEQ ID NO: 210155 - protein, 39 aa, Artificial Sequence
  Description of Artificial Sequence: Synthetic polypeptide
CEEEISTTNPCAYEQYGQCVCSNWGEDHNAENFTSDTQA

SEQ ID NO: 210156 - protein, 39 aa, Artificial Sequence
  Description of Artificial Sequence: Synthetic polypeptide
AEECIGTTNPVAYEAYGQCVCSNWGEDHNAENFNSDTQS

SEQ ID NO: 210157 - protein, 38 aa, Artificial Sequence
  Description of Artificial Sequence: Synthetic polypeptide
DEQEIACTNPVAYEQWGHCIIFAGNDGVLGDNDLNDAE

SEQ ID NO: 210158 - protein, 39 aa, Artificial Sequence
  Description of Artificial Sequence: Synthetic polypeptide
CEEEISTTNPCAYEQYGQCVCPNWGEDHNAENFISDTQA

SEQ ID NO: 210159 - protein, 39 aa, Artificial Sequence
  Description of Artificial Sequence: Synthetic polypeptide
CEEEISTTNPCATEGYGQCVCGNWGEDHNAENFISDTQS

SEQ ID NO: 210160 - protein, 36 aa, Artificial Sequence
  Description of Artificial Sequence: Synthetic polypeptide
TETEIRTTNPIAYECWGQATTPACAEHGAEITGPYI

SEQ ID NO: 210161 - protein, 38 aa, Artificial Sequence
  Description of Artificial Sequence: Synthetic polypeptide
DEQEIACTNPVAYEQWGHCIIFAGNDGLNDNDMLNDAE

SEQ ID NO: 210162 - protein, 38 aa, Artificial Sequence
  Description of Artificial Sequence: Synthetic polypeptide
DEACISCTNPVAYEGYGQCVCSMWEEHNDENFNSDTQA

SEQ ID NO: 210163 - protein, 38 aa, Artificial Sequence
  Description of Artificial Sequence: Synthetic polypeptide
DEQEIACTNPVAYEQWGHCIIFAGNDGLGTNDQLNDAE

SEQ ID NO: 210164 - protein, 35 aa, Artificial Sequence
  Description of Artificial Sequence: Synthetic polypeptide
QEGEIASTNPCSYEQWGITCYCNDQQDQSGQTVHI

SEQ ID NO: 210165 - protein, 35 aa, Artificial Sequence
  Description of Artificial Sequence: Synthetic polypeptide
QEGEIASTNPCSYEQWGITCYCNDQQDQSHQTGRH

SEQ ID NO: 210166 - protein, 36 aa, Artificial Sequence
  Description of Artificial Sequence: Synthetic polypeptide
TGSDEIATTNPVAYEAWGYASGDNNDDSGGKGGGQG

SEQ ID NO: 210167 - protein, 40 aa, Artificial Sequence
  Description of Artificial Sequence: Synthetic polypeptide
CEEEIRTTNPVAYEGWGQCISCQMSGEDHNAENFNSDTQS

SEQ ID NO: 210168 - protein, 39 aa, Artificial Sequence
  Description of Artificial Sequence: Synthetic polypeptide
DDAEISTTNPVATEGYGQCVCSMWEEDHNAENFISDTQS

SEQ ID NO: 210169 - protein, 36 aa, Artificial Sequence
  Description of Artificial Sequence: Synthetic polypeptide
TETEIRTTNPIAYECWGQATTPACATHWAEITGPYA

SEQ ID NO: 210170 - protein, 39 aa, Artificial Sequence
  Description of Artificial Sequence: Synthetic polypeptide
DDAEISTTNPVATEGYGQCVCPNWGEDHNAENFNSQTQS

SEQ ID NO: 210171 - protein, 39 aa, Artificial Sequence
  Description of Artificial Sequence: Synthetic polypeptide
DEACISCTNPVAYEGYGQCVCSNSGEDHNTENFNSDNQA

SEQ ID NO: 210172 - protein, 40 aa, Artificial Sequence
  Description of Artificial Sequence: Synthetic polypeptide
AEEAIRTTNPVAYEGYGQCAVCSNWGEDHNAESFNSDTQA

SEQ ID NO: 210173 - protein, 39 aa, Artificial Sequence
  Description of Artificial Sequence: Synthetic polypeptide
DDACISTTNPVATEGYGQCVCSNWGEDDNAEGFNSENQS

SEQ ID NO: 210174 - protein, 38 aa, Artificial Sequence
  Description of Artificial Sequence: Synthetic polypeptide
SEESICTNPVATEPYGNVATDQYGNVSEIYGVIPELLE

SEQ ID NO: 210175 - protein, 39 aa, Artificial Sequence
  Description of Artificial Sequence: Synthetic polypeptide
SEMEISTTNPVAYEQYGQCVCGNWGEDDNAENFNSETQA

SEQ ID NO: 210176 - protein, 39 aa, Artificial Sequence
  Description of Artificial Sequence: Synthetic polypeptide
SEMEISTTNPVAYEQYGQCVCQNWEEDHNAENFISDNQS

SEQ ID NO: 210177 - protein, 40 aa, Artificial Sequence
  Description of Artificial Sequence: Synthetic polypeptide
DEAEISTTNPVATEGYGQCQVCPNWGEDHNAEYFNSDNQS

SEQ ID NO: 210178 - protein, 39 aa, Artificial Sequence
  Description of Artificial Sequence: Synthetic polypeptide
SEMEISTTNPVAYEQYGQCVCYNWGEDHNTENFNSETQL

SEQ ID NO: 210179 - protein, 40 aa, Artificial Sequence
  Description of Artificial Sequence: Synthetic polypeptide
DEEEIRTTNPVGYYEPQWGSICNVTDAAEGTAHPMDLMAM

SEQ ID NO: 210180 - protein, 40 aa, Artificial Sequence
  Description of Artificial Sequence: Synthetic polypeptide
SENEISTTNPVATEQYGQCQVCSNWGEDHNAENFISETQS

SEQ ID NO: 210181 - protein, 39 aa, Artificial Sequence
  Description of Artificial Sequence: Synthetic polypeptide
SENEISTTNPVATEQWGICVCSNSGEDDNAEYSISDTAS

SEQ ID NO: 210182 - protein, 39 aa, Artificial Sequence
  Description of Artificial Sequence: Synthetic polypeptide
SENEISTTNPVATEQWGCQVCSNSGEDENAEYSISDTAS

SEQ ID NO: 210183 - protein, 39 aa, Artificial Sequence
  Description of Artificial Sequence: Synthetic polypeptide
SEMEVSTTNPVATEQYGQCVCSNWGEDHDAEYIGSDTQS

SEQ ID NO: 210184 - protein, 38 aa, Artificial Sequence
  Description of Artificial Sequence: Synthetic polypeptide
SENEIRTTNPVSYEGYGICICSNWEEDNAEQFNSDTQA

SEQ ID NO: 210185 - protein, 39 aa, Artificial Sequence
  Description of Artificial Sequence: Synthetic polypeptide
SENAISTTNPVATEQYGQCVCQNWGEDHNTEGFISDTQM

SEQ ID NO: 210186 - protein, 39 aa, Artificial Sequence
  Description of Artificial Sequence: Synthetic polypeptide
AEREISTTNPVAYEGYGQCVCSNWNEDPNAENFNSDFQS

SEQ ID NO: 210187 - protein, 38 aa, Artificial Sequence
  Description of Artificial Sequence: Synthetic polypeptide
SENCIATTNPVATEGYGCVCSNWMEDHNAEHFISETQA

SEQ ID NO: 210188 - protein, 39 aa, Artificial Sequence
  Description of Artificial Sequence: Synthetic polypeptide
DEAEISCTNPVATEGYGQCVCGNWGYDPNIENFNSETQS

SEQ ID NO: 210189 - protein, 39 aa, Artificial Sequence
  Description of Artificial Sequence: Synthetic polypeptide
SENCISTTNPVATEGYGQCVCSNWGEEHNAENFNSDTQS

SEQ ID NO: 210190 - protein, 39 aa, Artificial Sequence
  Description of Artificial Sequence: Synthetic polypeptide
AERCISTTNPVATEEYGQCVCSNWMEDHNAENFNSDFQP

SEQ ID NO: 210191 - protein, 35 aa, Artificial Sequence
  Description of Artificial Sequence: Synthetic polypeptide
QEHEIASTNPCSYEQWGITCYCNDQQDQSHQTIRN

SEQ ID NO: 210192 - protein, 37 aa, Artificial Sequence
  Description of Artificial Sequence: Synthetic polypeptide
DAAEIACTNPVAYEQWGTCASSGDGPAGNPAGNPNNQ

SEQ ID NO: 210193 - protein, 39 aa, Artificial Sequence
  Description of Artificial Sequence: Synthetic polypeptide
DDAAIGCTNPVAYEQYGQCVCSNWMEDHNTENFISDNAS

SEQ ID NO: 210194 - protein, 39 aa, Artificial Sequence
  Description of Artificial Sequence: Synthetic polypeptide
SEMEISTTNPVAYEQWGQCVCSNWGEDHNTENFNSDTQN

SEQ ID NO: 210195 - protein, 39 aa, Artificial Sequence
  Description of Artificial Sequence: Synthetic polypeptide
SEMEISTTNPVAYEGYGQCVCSNWGEGHNAENFNSDNQS

SEQ ID NO: 210196 - protein, 39 aa, Artificial Sequence
  Description of Artificial Sequence: Synthetic polypeptide
SEMEISTTNPVAYEGYGQCVCSNWGEDHNIESFNSENQS

SEQ ID NO: 210197 - protein, 39 aa, Artificial Sequence
  Description of Artificial Sequence: Synthetic polypeptide
SEMEISTTNPVAYEGYGQCVCSNWGEDHNAENFNSDTQA

SEQ ID NO: 210198 - protein, 37 aa, Artificial Sequence
  Description of Artificial Sequence: Synthetic polypeptide
DETEIRTTNPIAYECWGATTVACAEDEISAEPEVLYP

SEQ ID NO: 210199 - protein, 39 aa, Artificial Sequence
  Description of Artificial Sequence: Synthetic polypeptide
SETNVCIRATNPVATESYGSVCMYTIESAEPIIGQMDGF

SEQ ID NO: 210200 - protein, 40 aa, Artificial Sequence
  Description of Artificial Sequence: Synthetic polypeptide
SEMEISCTNPVAYEQYGQCQVCSTWGEDHNAESFNSDNQS

SEQ ID NO: 210201 - protein, 37 aa, Artificial Sequence
  Description of Artificial Sequence: Synthetic polypeptide
DETEIRTTNPIAYECWGCTTVACAEDEWSAEPTVPYI

SEQ ID NO: 210202 - protein, 38 aa, Artificial Sequence
  Description of Artificial Sequence: Synthetic polypeptide
SETAEIAACTNPVATAQWGCVAATIHLDFTMANDSANW

SEQ ID NO: 210203 - protein, 37 aa, Artificial Sequence
  Description of Artificial Sequence: Synthetic polypeptide
DETEIRTTNPLAYECWGQATTPACAEHWSAEPTGPYI

SEQ ID NO: 210204 - protein, 39 aa, Artificial Sequence
  Description of Artificial Sequence: Synthetic polypeptide
DEQEIATTNPVAYAPQPWGPIIATANGNDTPDNQTNGMD

SEQ ID NO: 210205 - protein, 38 aa, Artificial Sequence
  Description of Artificial Sequence: Synthetic polypeptide
DAAEIATTNPVAYEPPWGTNFSAGTGPAGNAHGDGGMH

SEQ ID NO: 210206 - protein, 36 aa, Artificial Sequence
  Description of Artificial Sequence: Synthetic polypeptide
DAAEIATTNPVAYAAWGCNTAGNNGPTEAEGGNLDS

SEQ ID NO: 210207 - protein, 37 aa, Artificial Sequence
  Description of Artificial Sequence: Synthetic polypeptide
AEQEIATTNPVAYEQWGHCIIFAGNSGLVDNDSEEGA

SEQ ID NO: 210208 - protein, 38 aa, Artificial Sequence
  Description of Artificial Sequence: Synthetic polypeptide
SESEIACTNPVGTEGYGQCSCQSGEDDNAEHFGSDTQS

SEQ ID NO: 210209 - protein, 38 aa, Artificial Sequence
  Description of Artificial Sequence: Synthetic polypeptide
SEMEISTTNPVAYEGYGICVCSNWGEPNAEFFISDTQA

SEQ ID NO: 210210 - protein, 39 aa, Artificial Sequence
  Description of Artificial Sequence: Synthetic polypeptide
SERCISTTNPVATEGYGQCVCSNWGEDHNAENFNSDTQS

SEQ ID NO: 210211 - protein, 39 aa, Artificial Sequence
  Description of Artificial Sequence: Synthetic polypeptide
SEMEISTTNPVAYEGYGQCVCSNSGEDHNAENFNSDTQA

SEQ ID NO: 210212 - protein, 39 aa, Artificial Sequence
  Description of Artificial Sequence: Synthetic polypeptide
SEMEISTTNPVAYEGYGQCVCSNWGEDHNAEGFNSDTQS

SEQ ID NO: 210213 - protein, 37 aa, Artificial Sequence
  Description of Artificial Sequence: Synthetic polypeptide
SEQEIACTNPVAYEQWGHCIIFAGNSGLVDNDSNDAE

SEQ ID NO: 210214 - protein, 39 aa, Artificial Sequence
  Description of Artificial Sequence: Synthetic polypeptide
SEMEISTTNPVAYEGYGQCVCSNWGEDHNAENFISENQS

SEQ ID NO: 210215 - protein, 39 aa, Artificial Sequence
  Description of Artificial Sequence: Synthetic polypeptide
SEMEISTTNPVAYEGYGQCVCSNWGEDHNAENFNSDPQL

SEQ ID NO: 210216 - protein, 38 aa, Artificial Sequence
  Description of Artificial Sequence: Synthetic polypeptide
SEPVIVITTTNPVATETIILMQHIFETNLQERVIEFGT

SEQ ID NO: 210217 - protein, 38 aa, Artificial Sequence
  Description of Artificial Sequence: Synthetic polypeptide
SENEISTTNPVAYEQWGCVCSNSGEDENAEYFISDTAS

SEQ ID NO: 210218 - protein, 39 aa, Artificial Sequence
  Description of Artificial Sequence: Synthetic polypeptide
SEMEISTTNPVAYEEYGQCVCSNWGEDHNAEFFNSDTQL

SEQ ID NO: 210219 - protein, 39 aa, Artificial Sequence
  Description of Artificial Sequence: Synthetic polypeptide
DDAAIGTTNPVAYEGYGQCVCSNWMEDHNTENFISDNAA

SEQ ID NO: 210220 - protein, 38 aa, Artificial Sequence
  Description of Artificial Sequence: Synthetic polypeptide
SENCISTTNPVAYEYYGQCVCSNWGEHNAENFNSQTQL

SEQ ID NO: 210221 - protein, 38 aa, Artificial Sequence
  Description of Artificial Sequence: Synthetic polypeptide
SENEIACTNPVATEGYGCVCSMWGEDHNAEHFISETQA

SEQ ID NO: 210222 - protein, 39 aa, Artificial Sequence
  Description of Artificial Sequence: Synthetic polypeptide
DDACIGTTNPVAYEGYGQCVCSNWGEDHNTENFNSDNAS

SEQ ID NO: 210223 - protein, 36 aa, Artificial Sequence
  Description of Artificial Sequence: Synthetic polypeptide
QEHEIATTNPVAYESYGEHAPCCEHEFSIHAEGEWQ

SEQ ID NO: 210224 - protein, 39 aa, Artificial Sequence
  Description of Artificial Sequence: Synthetic polypeptide
DEAEISTTNPEAYEGYGQCVCSNWGEDHNAENFNSDTQS

SEQ ID NO: 210225 - protein, 38 aa, Artificial Sequence
  Description of Artificial Sequence: Synthetic polypeptide
DEAEISTTNGVAYCGYGQCVCSNWGEHNAEYFISDNQS

SEQ ID NO: 210226 - protein, 37 aa, Artificial Sequence
  Description of Artificial Sequence: Synthetic polypeptide
QEHEIATTNPVAYESYGEHAPWCEGHEFSINAEGEWH

SEQ ID NO: 210227 - protein, 37 aa, Artificial Sequence
  Description of Artificial Sequence: Synthetic polypeptide
QEHEIATTNPVAYESYGEHAPWCEHEFSINASGEYWQ

SEQ ID NO: 210228 - protein, 37 aa, Artificial Sequence
  Description of Artificial Sequence: Synthetic polypeptide
QEHEIATTNPVAYESYGEHAPWCEQHEFSMNAEGEWQ

SEQ ID NO: 210229 - protein, 38 aa, Artificial Sequence
  Description of Artificial Sequence: Synthetic polypeptide
AENEISTTNPVAYEGWGQCVTSNSMEENAEAFNSDTAA

SEQ ID NO: 210230 - protein, 39 aa, Artificial Sequence
  Description of Artificial Sequence: Synthetic polypeptide
DEAEISTTNGVAYCQYGQCVCSNWGEDHNTEYFGSDTQS

SEQ ID NO: 210231 - protein, 39 aa, Artificial Sequence
  Description of Artificial Sequence: Synthetic polypeptide
AENEISTTNPVATEGWGQCVTSNWGEDENTENFISDTAS

SEQ ID NO: 210232 - protein, 37 aa, Artificial Sequence
  Description of Artificial Sequence: Synthetic polypeptide
DSSEVASTNPVSYEPYGNVVAANATISQISTGGANSL

SEQ ID NO: 210233 - protein, 39 aa, Artificial Sequence
  Description of Artificial Sequence: Synthetic polypeptide
AENEISTVNPVATEGYGQCVCSNWGEDHNAENFNSDFQA

SEQ ID NO: 210234 - protein, 39 aa, Artificial Sequence
  Description of Artificial Sequence: Synthetic polypeptide
AENEISTTNPVAYEGYGQCVCSNSGEEHNAENFNSDTQS

SEQ ID NO: 210235 - protein, 39 aa, Artificial Sequence
  Description of Artificial Sequence: Synthetic polypeptide
AENEISTTNPVAYEYYGQCVCSNWGEDHNAENFNSQTQL

SEQ ID NO: 210236 - protein, 39 aa, Artificial Sequence
  Description of Artificial Sequence: Synthetic polypeptide
SENEIATTNPVATEGYGQCVCSNWGEDHNAEHFISETQA

SEQ ID NO: 210237 - protein, 39 aa, Artificial Sequence
  Description of Artificial Sequence: Synthetic polypeptide
DEAEISTTNPCATEGFGQCVCSNWGEDHNAENFNSENQL

SEQ ID NO: 210238 - protein, 39 aa, Artificial Sequence
  Description of Artificial Sequence: Synthetic polypeptide
DEAEISTTNPCAYEGYGQCVCSNWEADHNAENFNSDTQA

SEQ ID NO: 210239 - protein, 39 aa, Artificial Sequence
  Description of Artificial Sequence: Synthetic polypeptide
AENEISTTNPVAYEGYGQCVCSNWGEDHNAEGSNSDNQS

SEQ ID NO: 210240 - protein, 38 aa, Artificial Sequence
  Description of Artificial Sequence: Synthetic polypeptide
DEAEISTTNPCAYEGWGCQTCGNAEEDNAENSGSDNQA

SEQ ID NO: 210241 - protein, 39 aa, Artificial Sequence
  Description of Artificial Sequence: Synthetic polypeptide
AENEISTTNPVAYEQYGQCVCSNWGEDHNAENFSSETQS

SEQ ID NO: 210242 - protein, 40 aa, Artificial Sequence
  Description of Artificial Sequence: Synthetic polypeptide
AENEISTTNPVAYEGYGQCQVCSNWGEDHNTESFGSDNQA

SEQ ID NO: 210243 - protein, 36 aa, Artificial Sequence
  Description of Artificial Sequence: Synthetic polypeptide
DETEIRTTNPIAYECWGATTPACAGHWPAEPTGPYI

SEQ ID NO: 210244 - protein, 39 aa, Artificial Sequence
  Description of Artificial Sequence: Synthetic polypeptide
DEAEISCTNPVAYEQYGQCVCSNSGEDHNAENFISDTQS

SEQ ID NO: 210245 - protein, 39 aa, Artificial Sequence
  Description of Artificial Sequence: Synthetic polypeptide
DEAEISCTNPVAYEQYGQCVCQMWGEDDNAENFNSDTQA

SEQ ID NO: 210246 - protein, 39 aa, Artificial Sequence
  Description of Artificial Sequence: Synthetic polypeptide
AENEISCTNPVATEQYGQCVCGNWGEEHNAENFNSDTQS

SEQ ID NO: 210247 - protein, 39 aa, Artificial Sequence
  Description of Artificial Sequence: Synthetic polypeptide
AENEISCTNPVAYEQYGQCVCSNWEEEHNAENFQSDTQS

SEQ ID NO: 210248 - protein, 39 aa, Artificial Sequence
  Description of Artificial Sequence: Synthetic polypeptide
DEAEISCTNPVAYEGYGQCSCGNWEALHNAEHFNSDTQA

SEQ ID NO: 210249 - protein, 38 aa, Artificial Sequence
  Description of Artificial Sequence: Synthetic polypeptide
AENEISCVNPVAYEQYGCVCSNWGEDHNAENFNSDFQA

SEQ ID NO: 210250 - protein, 39 aa, Artificial Sequence
  Description of Artificial Sequence: Synthetic polypeptide
DEAEISCTNPVAYEGYGQCVCSNSEEDDNAENFNSDTQF

SEQ ID NO: 210251 - protein, 39 aa, Artificial Sequence
  Description of Artificial Sequence: Synthetic polypeptide
DDAAISTTNPVATEQYGQCVCSNWEEDDNAENFISDFQS

SEQ ID NO: 210252 - protein, 39 aa, Artificial Sequence
  Description of Artificial Sequence: Synthetic polypeptide
DEAEISCTNPVAYEGYGQCVCSNSGEDHNAENFISDNQA

SEQ ID NO: 210253 - protein, 39 aa, Artificial Sequence
  Description of Artificial Sequence: Synthetic polypeptide
DEAEISCTNPVAYEGYGQCVCSNSGEGHNAEGFNSDNQS

SEQ ID NO: 210254 - protein, 39 aa, Artificial Sequence
  Description of Artificial Sequence: Synthetic polypeptide
AENEISTTNPCATEGYGQCVCSNWGEGHNAENFNSDNQS

SEQ ID NO: 210255 - protein, 38 aa, Artificial Sequence
  Description of Artificial Sequence: Synthetic polypeptide
DDAAISTTNPVAYEGYGCVCSNWEEDHNAENFGSDFQS

SEQ ID NO: 210256 - protein, 39 aa, Artificial Sequence
  Description of Artificial Sequence: Synthetic polypeptide
DEAEISCTNPVAYEGYGQCVCSNWEEAHNTEGFNSDNQA

SEQ ID NO: 210257 - protein, 39 aa, Artificial Sequence
  Description of Artificial Sequence: Synthetic polypeptide
DEAEISCTNPVAYEGYGQCVCSNWGEDDNAENFNSDTQA

SEQ ID NO: 210258 - protein, 39 aa, Artificial Sequence
  Description of Artificial Sequence: Synthetic polypeptide
DEAEISCTNPVAYEGYGQCVCSNWGEDHNAEGSNSDTQP

SEQ ID NO: 210259 - protein, 39 aa, Artificial Sequence
  Description of Artificial Sequence: Synthetic polypeptide
DEAEISCTNPVAYEGYGQCVCSNWVEDHNAENFNSDPQS

SEQ ID NO: 210260 - protein, 39 aa, Artificial Sequence
  Description of Artificial Sequence: Synthetic polypeptide
AENEISTTNPCAYEQYGQCVCSNWGEDDNAENFISDNQA

SEQ ID NO: 210261 - protein, 39 aa, Artificial Sequence
  Description of Artificial Sequence: Synthetic polypeptide
DEAEISCTNPVAYEQWGQCVCSNWMEDHNAENFNSDTQD

SEQ ID NO: 210262 - protein, 39 aa, Artificial Sequence
  Description of Artificial Sequence: Synthetic polypeptide
AENEISTTNPCAYEQYGQCVCSNWGEDHNAENFNSDNQS

SEQ ID NO: 210263 - protein, 39 aa, Artificial Sequence
  Description of Artificial Sequence: Synthetic polypeptide
DEAEISCTNPVAYEQYGQCICSNWGEDHNAESFNSDNQP

SEQ ID NO: 210264 - protein, 39 aa, Artificial Sequence
  Description of Artificial Sequence: Synthetic polypeptide
DEAEISCTNPVAYEQYGQCVCGNWGEDDNAEYFNSENQA

SEQ ID NO: 210265 - protein, 39 aa, Artificial Sequence
  Description of Artificial Sequence: Synthetic polypeptide
DEAEISCTNPVAYEQYGQCVCGNWGEDHNAENFTSDNQS

SEQ ID NO: 210266 - protein, 39 aa, Artificial Sequence
  Description of Artificial Sequence: Synthetic polypeptide
DEAEISCTNPVAYEGYGQCVCSNWEEDTNIENFISDTQA

SEQ ID NO: 210267 - protein, 39 aa, Artificial Sequence
  Description of Artificial Sequence: Synthetic polypeptide
AEECISCTNPVATEEYGQCVCSNWGEDDNAENFNSDTQP

SEQ ID NO: 210268 - protein, 39 aa, Artificial Sequence
  Description of Artificial Sequence: Synthetic polypeptide
SEMEIRTTNPVAYEQWGQCVCSNSGEDENAEYSISDTAS

SEQ ID NO: 210269 - protein, 39 aa, Artificial Sequence
  Description of Artificial Sequence: Synthetic polypeptide
DEACIGTTNPVAYEQWGQCVCSNWGEDHNAEFFNSDTQS

SEQ ID NO: 210270 - protein, 39 aa, Artificial Sequence
  Description of Artificial Sequence: Synthetic polypeptide
DETEIRTTNPCATEGWGQCQSCQNWEEDNAENSNSDNQA

SEQ ID NO: 210271 - protein, 38 aa, Artificial Sequence
  Description of Artificial Sequence: Synthetic polypeptide
SEMCISCTNPVAYEQYGQCVCSNWGEHNAENFNSDNQG

SEQ ID NO: 210272 - protein, 38 aa, Artificial Sequence
  Description of Artificial Sequence: Synthetic polypeptide
DETEIRTTNPIATEAWGATTPANVGDAWSSEPTGTKYI

SEQ ID NO: 210273 - protein, 37 aa, Artificial Sequence
  Description of Artificial Sequence: Synthetic polypeptide
DETEIRTTNPIATECWGATTAACAEDAHAEPTGGPYI

SEQ ID NO: 210274 - protein, 40 aa, Artificial Sequence
  Description of Artificial Sequence: Synthetic polypeptide
SEMCISTTNPVATEQYGQCQVCGNSGEDDNTENFNSETQA

SEQ ID NO: 210275 - protein, 37 aa, Artificial Sequence
  Description of Artificial Sequence: Synthetic polypeptide
DETEIRTTNPIATECWGATTPACAEGEWEEPTGGPYI

SEQ ID NO: 210276 - protein, 38 aa, Artificial Sequence
  Description of Artificial Sequence: Synthetic polypeptide
DETEIRTTNPIATECWGATTPALAGDAWSAEPTGTPYM

SEQ ID NO: 210277 - protein, 38 aa, Artificial Sequence
  Description of Artificial Sequence: Synthetic polypeptide
DETEIRTTNPIATECWGATTPANAGHAWSAEPTGTTYI

SEQ ID NO: 210278 - protein, 38 aa, Artificial Sequence
  Description of Artificial Sequence: Synthetic polypeptide
DETEIRTTNPIATECWGATTPANCGDAWSAEPTGTPYI

SEQ ID NO: 210279 - protein, 38 aa, Artificial Sequence
  Description of Artificial Sequence: Synthetic polypeptide
DETEIRTTNPIATECWGATTPATAGSAWSAEPTGTPYI

SEQ ID NO: 210280 - protein, 38 aa, Artificial Sequence
  Description of Artificial Sequence: Synthetic polypeptide
DETEIRTTNPIATECWGATTPAYAGDAWSEEPTGTPYI

SEQ ID NO: 210281 - protein, 37 aa, Artificial Sequence
  Description of Artificial Sequence: Synthetic polypeptide
DETEIRTTNPIATECWGATTQACAEDEWAEPTGGPYQ

SEQ ID NO: 210282 - protein, 39 aa, Artificial Sequence
  Description of Artificial Sequence: Synthetic polypeptide
SEMCISTTNPVAYEGYGQCVCSTWGEDHNAESFNSDNQS

SEQ ID NO: 210283 - protein, 39 aa, Artificial Sequence
  Description of Artificial Sequence: Synthetic polypeptide
SEMCISTTNPVAYEQYGQCVCSNWGEDHNIESFISENQS

SEQ ID NO: 210284 - protein, 38 aa, Artificial Sequence
  Description of Artificial Sequence: Synthetic polypeptide
DEQEIATTNPVAYEQWGHCIIFAGNSGLVDNSSEEDAW

SEQ ID NO: 210285 - protein, 38 aa, Artificial Sequence
  Description of Artificial Sequence: Synthetic polypeptide
DEAAISCTNPVAYEEYGQCVCSNSGEHNAEYFNSDNQS

SEQ ID NO: 210286 - protein, 39 aa, Artificial Sequence
  Description of Artificial Sequence: Synthetic polypeptide
DEAAISCTNPVAYEGYGQCVCSNWGEDHNTENFGSDNAS

SEQ ID NO: 210287 - protein, 39 aa, Artificial Sequence
  Description of Artificial Sequence: Synthetic polypeptide
SEMCIVTTNPVATEGYGQCVCSNWGEDPNAENFGSDTQA

SEQ ID NO: 210288 - protein, 38 aa, Artificial Sequence
  Description of Artificial Sequence: Synthetic polypeptide
DEQEIATTNPVAYEQWGHCIIFAGNSGLVDNDSEQDAP

SEQ ID NO: 210289 - protein, 38 aa, Artificial Sequence
  Description of Artificial Sequence: Synthetic polypeptide
DETEIRTTNPCATECWGWATRPAMSEDIAEIEGEPEIK

SEQ ID NO: 210290 - protein, 38 aa, Artificial Sequence
  Description of Artificial Sequence: Synthetic polypeptide
DEDEIACTNPVAYEQWGGCTVAGATGDLAEPAAPTDSQ

SEQ ID NO: 210291 - protein, 37 aa, Artificial Sequence
  Description of Artificial Sequence: Synthetic polypeptide
QEGEIATTNPVAYEAYGEHAPWCEHEFSQSHAEGEWC

SEQ ID NO: 210292 - protein, 39 aa, Artificial Sequence
  Description of Artificial Sequence: Synthetic polypeptide
DETEIATTNPVAYAPVWGHSHSAGNSGEPTQGVQDNHSM

SEQ ID NO: 210293 - protein, 37 aa, Artificial Sequence
  Description of Artificial Sequence: Synthetic polypeptide
SEESICTNVATEQYGNVATTQYGNVNNIYGVIPELVE

SEQ ID NO: 210294 - protein, 39 aa, Artificial Sequence
  Description of Artificial Sequence: Synthetic polypeptide
DDACISTTNPVATEGYGQCVCSNWEEDHNIENFSSDNQS

SEQ ID NO: 210295 - protein, 39 aa, Artificial Sequence
  Description of Artificial Sequence: Synthetic polypeptide
DETEIATTNPIATECWGVATTNAGATDGPAEPKGSPYNN

SEQ ID NO: 210296 - protein, 37 aa, Artificial Sequence
  Description of Artificial Sequence: Synthetic polypeptide
DETEIATTNPIATECWGVTTWAGATDGPAEPKGSPEN

SEQ ID NO: 210297 - protein, 38 aa, Artificial Sequence
  Description of Artificial Sequence: Synthetic polypeptide
AEEAIGTTNPVAYEGYGQCVCQNWGEHNAENFNSDTQA

SEQ ID NO: 210298 - protein, 37 aa, Artificial Sequence
  Description of Artificial Sequence: Synthetic polypeptide
DETEIATTNPIAYAPWGTTTSANATDGPAEPKGNPQN

SEQ ID NO: 210299 - protein, 39 aa, Artificial Sequence
  Description of Artificial Sequence: Synthetic polypeptide
DDACISTTNPCATEQYGQCVCSNWGEDHNAEGFNSDPQQ

SEQ ID NO: 210300 - protein, 36 aa, Artificial Sequence
  Description of Artificial Sequence: Synthetic polypeptide
DETEIATTNPIAYEPWGATTTAGATDGPAEAKGPYN

SEQ ID NO: 210301 - protein, 38 aa, Artificial Sequence
  Description of Artificial Sequence: Synthetic polypeptide
DETEIATTNPIAYEPWGATTVALATDGPAEPKGNPQNP

SEQ ID NO: 210302 - protein, 39 aa, Artificial Sequence
  Description of Artificial Sequence: Synthetic polypeptide
DEAAISTTNPEATEGYGQCVCSNWGEPHNAENFNSENQA

SEQ ID NO: 210303 - protein, 37 aa, Artificial Sequence
  Description of Artificial Sequence: Synthetic polypeptide
DETEIATTNPIAYEPWGATTVALATDGPAEPKGSPDN

SEQ ID NO: 210304 - protein, 39 aa, Artificial Sequence
  Description of Artificial Sequence: Synthetic polypeptide
DENEISTTNPVATEAWGICVCSNSGEDHNAEYSISDTAS

SEQ ID NO: 210305 - protein, 39 aa, Artificial Sequence
  Description of Artificial Sequence: Synthetic polypeptide
DENEISCTNPVAYEQWGQCVCSNWGEDHNAENFNSDTQQ

SEQ ID NO: 210306 - protein, 39 aa, Artificial Sequence
  Description of Artificial Sequence: Synthetic polypeptide
DEDEIATTNPVATAQWGGCTCAGAGPAGSADPPQGNTHQ

SEQ ID NO: 210307 - protein, 40 aa, Artificial Sequence
  Description of Artificial Sequence: Synthetic polypeptide
DETEIATTNPVATEQWGCTNNQANMNGVDTATANIDEEWP

SEQ ID NO: 210308 - protein, 39 aa, Artificial Sequence
  Description of Artificial Sequence: Synthetic polypeptide
DENEIRTTNPVSYEGYGQCICSNWEEDDNAEQFNSDTQA

SEQ ID NO: 210309 - protein, 38 aa, Artificial Sequence
  Description of Artificial Sequence: Synthetic polypeptide
DEDEIATTNPVATAQWGGCCAGAGPATSADPPQGITHQ

SEQ ID NO: 210310 - protein, 38 aa, Artificial Sequence
  Description of Artificial Sequence: Synthetic polypeptide
DEDEIATTNPIATECWGATYYANENDHTLHDKTGKGMS

SEQ ID NO: 210311 - protein, 38 aa, Artificial Sequence
  Description of Artificial Sequence: Synthetic polypeptide
AESEIACTNPVGTEGYGQVSCGSGEDHNQEHFGSDTQS

SEQ ID NO: 210312 - protein, 39 aa, Artificial Sequence
  Description of Artificial Sequence: Synthetic polypeptide
AESEIACTNPVGTEGYGQCSCGNSGEDHNAEHFGSDNQS

SEQ ID NO: 210313 - protein, 37 aa, Artificial Sequence
  Description of Artificial Sequence: Synthetic polypeptide
DETEIATTNPTAYECWGATTSANATDGPAEPKGSPEN

SEQ ID NO: 210314 - protein, 37 aa, Artificial Sequence
  Description of Artificial Sequence: Synthetic polypeptide
DDSEVACTNPVSTEGYGCVCQTWGEDINQEYFGSQQS

SEQ ID NO: 210315 - protein, 36 aa, Artificial Sequence
  Description of Artificial Sequence: Synthetic polypeptide
SEMEIACTNPCSYEGYGCVCSWGEDHNAESFGSDQA

SEQ ID NO: 210316 - protein, 38 aa, Artificial Sequence
  Description of Artificial Sequence: Synthetic polypeptide
DEQEIATTNPVAYEQWGHCIIFAGNSGLVDNDSEEDVM

SEQ ID NO: 210317 - protein, 39 aa, Artificial Sequence
  Description of Artificial Sequence: Synthetic polypeptide
DEAAISTTNPVAYEQWGQCVCSNWEEDHNAENFGSDFQS

SEQ ID NO: 210318 - protein, 39 aa, Artificial Sequence
  Description of Artificial Sequence: Synthetic polypeptide
DEAAISTTNPVAYEQYGQCVCSMWGEDHNAENFISDPQA

SEQ ID NO: 210319 - protein, 38 aa, Artificial Sequence
  Description of Artificial Sequence: Synthetic polypeptide
DEDEIACTNPVATEQWGACIITAAGPHVDAPMNANGTE

SEQ ID NO: 210320 - protein, 39 aa, Artificial Sequence
  Description of Artificial Sequence: Synthetic polypeptide
TDACISTTNPVATEQYGQCVCSMWGEDHNAEHFNSDTQL

SEQ ID NO: 210321 - protein, 39 aa, Artificial Sequence
  Description of Artificial Sequence: Synthetic polypeptide
DDACISCTNPVATEQYGQCVCSNWGEDDNAEGFNSETQS

SEQ ID NO: 210322 - protein, 40 aa, Artificial Sequence
  Description of Artificial Sequence: Synthetic polypeptide
STVLEVRGTANPIATEQYPGSVSSTICILCQLFAQHTTQI

SEQ ID NO: 210323 - protein, 39 aa, Artificial Sequence
  Description of Artificial Sequence: Synthetic polypeptide
DDACIRTTNPVAYEQYGQCVCGNWEEDHNAEHFNSETQA

SEQ ID NO: 210324 - protein, 38 aa, Artificial Sequence
  Description of Artificial Sequence: Synthetic polypeptide
SEMEIACTNPCSYEQYGQCVCSNWGEDNQESFGSDNQS

SEQ ID NO: 210325 - protein, 38 aa, Artificial Sequence
  Description of Artificial Sequence: Synthetic polypeptide
DEQEIATTNPVAYEPWGRPPPAGQGPALQEHQDGMPAV

SEQ ID NO: 210326 - protein, 39 aa, Artificial Sequence
  Description of Artificial Sequence: Synthetic polypeptide
DEAAISTTNPVAYEGYGQCVCSNWEEDHNAENFNSDFQS

SEQ ID NO: 210327 - protein, 39 aa, Artificial Sequence
  Description of Artificial Sequence: Synthetic polypeptide
DEACIGTTNPVAYEHYGQCVCSNWGEDHNAENFNSDTQQ

SEQ ID NO: 210328 - protein, 37 aa, Artificial Sequence
  Description of Artificial Sequence: Synthetic polypeptide
DETEIRTTNPIATECWGQTTPACAEDEAAEPTGGPYI

SEQ ID NO: 210329 - protein, 37 aa, Artificial Sequence
  Description of Artificial Sequence: Synthetic polypeptide
DETEIRTTNPIATEPWGATTPACIEDWSAEPTGPYGW

SEQ ID NO: 210330 - protein, 37 aa, Artificial Sequence
  Description of Artificial Sequence: Synthetic polypeptide
DETEIRTTNPIATEPWGTTTPACAGDEWAEPKGGPYI

SEQ ID NO: 210331 - protein, 38 aa, Artificial Sequence
  Description of Artificial Sequence: Synthetic polypeptide
DAAEIATTNPVAYEQWGTCASSGDGPAGNPAGNPNEQG

SEQ ID NO: 210332 - protein, 39 aa, Artificial Sequence
  Description of Artificial Sequence: Synthetic polypeptide
SEYEIRCTNPVATEGYGQCVCENWGEDHNAEHFISDTQS

SEQ ID NO: 210333 - protein, 38 aa, Artificial Sequence
  Description of Artificial Sequence: Synthetic polypeptide
SEYCISCTNPVATEQYGCVCENWGEDHNAEHFMSDTQS

SEQ ID NO: 210334 - protein, 38 aa, Artificial Sequence
  Description of Artificial Sequence: Synthetic polypeptide
AENEIRTTNPVAYEGWGCVCSNSGEDDNAEYSISDTAS

SEQ ID NO: 210335 - protein, 39 aa, Artificial Sequence
  Description of Artificial Sequence: Synthetic polypeptide
AENEIRTTNPVAYEQWGICVCGNSGEDENAEYSISDTAS

SEQ ID NO: 210336 - protein, 38 aa, Artificial Sequence
  Description of Artificial Sequence: Synthetic polypeptide
SEYCIRCTNPVAYEQYGCVCENWGEDHNAEHFNSDTQS

SEQ ID NO: 210337 - protein, 39 aa, Artificial Sequence
  Description of Artificial Sequence: Synthetic polypeptide
DETEIRTTNPIATECWGIATTPANVGDAWSSEPTGTPYI

SEQ ID NO: 210338 - protein, 36 aa, Artificial Sequence
  Description of Artificial Sequence: Synthetic polypeptide
CEEEIATTNPVAYAPPWGPTACAAANGDAMQGDQHL

SEQ ID NO: 210339 - protein, 39 aa, Artificial Sequence
  Description of Artificial Sequence: Synthetic polypeptide
DEDEIACTNPVATEQWGCIITAATNHVDIAPMNPNGSLE

SEQ ID NO: 210340 - protein, 39 aa, Artificial Sequence
  Description of Artificial Sequence: Synthetic polypeptide
TDEEISTTNPVAYEGYGQCVCSNWEEDHNAENFNSDTQQ

SEQ ID NO: 210341 - protein, 36 aa, Artificial Sequence
  Description of Artificial Sequence: Synthetic polypeptide
SEMEIACTNPCSYEQYGCVCGWGEHNQESFGSDTQA

SEQ ID NO: 210342 - protein, 40 aa, Artificial Sequence
  Description of Artificial Sequence: Synthetic polypeptide
DEAAISTTNPVATEGYGQCAVCSNWGEAHNAEFFISDNQA

SEQ ID NO: 210343 - protein, 37 aa, Artificial Sequence
  Description of Artificial Sequence: Synthetic polypeptide
SEMEIACTNPCSYEQYGCVCSDWGEDDNQESFGSDQA

SEQ ID NO: 210344 - protein, 37 aa, Artificial Sequence
  Description of Artificial Sequence: Synthetic polypeptide
SEMEIACTNPCSYEQYGCVCSNWEEDNQESFGSDTQM

SEQ ID NO: 210345 - protein, 38 aa, Artificial Sequence
  Description of Artificial Sequence: Synthetic polypeptide
DEDEIACTNPVATEQWGGCIAGKAGADGSATPDDEMTE

SEQ ID NO: 210346 - protein, 38 aa, Artificial Sequence
  Description of Artificial Sequence: Synthetic polypeptide
DEDEIACTNPVATEQWGGCCALQGNPDFNTAAPGEGPH

SEQ ID NO: 210347 - protein, 39 aa, Artificial Sequence
  Description of Artificial Sequence: Synthetic polypeptide
DEAAISTTNPVATEGYGQCVCGNSGEDHNAENFPSDTQS

SEQ ID NO: 210348 - protein, 36 aa, Artificial Sequence
  Description of Artificial Sequence: Synthetic polypeptide
DDSEVACTNPVSTEGYGCVCGNWEDNTEYFGSQTQA

SEQ ID NO: 210349 - protein, 37 aa, Artificial Sequence
  Description of Artificial Sequence: Synthetic polypeptide
SEMEIACTNPCSYEQYGCVCSNWGEDNAESFGSDTQS

SEQ ID NO: 210350 - protein, 40 aa, Artificial Sequence
  Description of Artificial Sequence: Synthetic polypeptide
DEAAISTTNPVAYEGYGQCQVCSNWGEDHNTENFNSDNAS

SEQ ID NO: 210351 - protein, 38 aa, Artificial Sequence
  Description of Artificial Sequence: Synthetic polypeptide
DEQEIATTNPVAYEQWGHCIIFAGNSGDVDNDSEEHAM

SEQ ID NO: 210352 - protein, 37 aa, Artificial Sequence
  Description of Artificial Sequence: Synthetic polypeptide
DDSEVACTNPVSTEGYGCVCFNWMEHNQEYFNSQTQA

SEQ ID NO: 210353 - protein, 36 aa, Artificial Sequence
  Description of Artificial Sequence: Synthetic polypeptide
TEAEIRTTNPIAYECWGQATTPACAEHWAEKTGPYI

SEQ ID NO: 210354 - protein, 40 aa, Artificial Sequence
  Description of Artificial Sequence: Synthetic polypeptide
TEACISCTNPVATEQYGQCQVCSTWGEDHNAENFNSDTQS

SEQ ID NO: 210355 - protein, 39 aa, Artificial Sequence
  Description of Artificial Sequence: Synthetic polypeptide
TEAAIGTTNPVAYEGYGQCVCSNWGEDHNTENFNSDNQS

SEQ ID NO: 210356 - protein, 37 aa, Artificial Sequence
  Description of Artificial Sequence: Synthetic polypeptide
SEMEIACTNPCSYEQYGCVCSWGEDDNAESFGSDTQA

SEQ ID NO: 210357 - protein, 37 aa, Artificial Sequence
  Description of Artificial Sequence: Synthetic polypeptide
SEMEIACTNPCSYEQYGCVCSWGEDDNQESFSSDNQS

SEQ ID NO: 210358 - protein, 36 aa, Artificial Sequence
  Description of Artificial Sequence: Synthetic polypeptide
SEMEIACTNPCSYEQYGCVCSWGEHNAESFISDTQA

SEQ ID NO: 210359 - protein, 42 aa, Artificial Sequence
  Description of Artificial Sequence: Synthetic polypeptide
TDSEWGIVCTTNHPVATKEAYGICTVCCIGNSLQDNVGNQVV

SEQ ID NO: 210360 - protein, 36 aa, Artificial Sequence
  Description of Artificial Sequence: Synthetic polypeptide
SEMEIACTNPCSYEQYGCVCSWMEDDNQESFISDQS

SEQ ID NO: 210361 - protein, 37 aa, Artificial Sequence
  Description of Artificial Sequence: Synthetic polypeptide
SEMEIACTNPCSYEQYGCVCSNWMEDNQESFNSDTQA

SEQ ID NO: 210362 - protein, 39 aa, Artificial Sequence
  Description of Artificial Sequence: Synthetic polypeptide
DDAEISTTNPVAYEGYGQCVCSDWGEDHNTENFISDTQS

SEQ ID NO: 210363 - protein, 35 aa, Artificial Sequence
  Description of Artificial Sequence: Synthetic polypeptide
TESSICTTNPVAYGPYGQSASCWSASSSSAVTSEE

SEQ ID NO: 210364 - protein, 38 aa, Artificial Sequence
  Description of Artificial Sequence: Synthetic polypeptide
DDMCIATTNPVATEGYGCVCSNWGEDPNAEFFISDTQA

SEQ ID NO: 210365 - protein, 40 aa, Artificial Sequence
  Description of Artificial Sequence: Synthetic polypeptide
CEAEIRTTNPVATEGWGQCASCSNWGEDHNAENFNSDTQS

SEQ ID NO: 210366 - protein, 39 aa, Artificial Sequence
  Description of Artificial Sequence: Synthetic polypeptide
DDMCISTTNPVAYEGYGQCVCSTWGEDHNAENFQSDTQP

SEQ ID NO: 210367 - protein, 39 aa, Artificial Sequence
  Description of Artificial Sequence: Synthetic polypeptide
AEECISTTNPVAYEGYGQCVCSNWGEGHNAENFNSDNQG

SEQ ID NO: 210368 - protein, 39 aa, Artificial Sequence
  Description of Artificial Sequence: Synthetic polypeptide
DDMCISTTNPVAYEQYGQCIVCSNWGEHNAESFNSETQS

SEQ ID NO: 210369 - protein, 39 aa, Artificial Sequence
  Description of Artificial Sequence: Synthetic polypeptide
DDMCISTTNPVAYEQYGQCVCSNWGEDDNAEFFNSDTQS

SEQ ID NO: 210370 - protein, 39 aa, Artificial Sequence
  Description of Artificial Sequence: Synthetic polypeptide
DDMCISTTNPVAYEQYGQCVCSNWGEDDNAEGFNSETQS

SEQ ID NO: 210371 - protein, 39 aa, Artificial Sequence
  Description of Artificial Sequence: Synthetic polypeptide
DDMCISTTNPVAYEQYGQCVCSNWGEDHNAEFFNSDTQG

SEQ ID NO: 210372 - protein, 39 aa, Artificial Sequence
  Description of Artificial Sequence: Synthetic polypeptide
DEACISTTNPVAYEGYGQCVCSDWGEDHNTENFISDTQA

SEQ ID NO: 210373 - protein, 39 aa, Artificial Sequence
  Description of Artificial Sequence: Synthetic polypeptide
DEACISTTNPVAYEGYGQCVCSDWGEDHNAENSNSENQA

SEQ ID NO: 210374 - protein, 39 aa, Artificial Sequence
  Description of Artificial Sequence: Synthetic polypeptide
DEMEIRTTNPCATEGWGQCQTCQNAEEDNAENSNSDNQA

SEQ ID NO: 210375 - protein, 39 aa, Artificial Sequence
  Description of Artificial Sequence: Synthetic polypeptide
DEACISTTNPVAYEGYGQCVCGTWGEDDNAENFNSDTQA

SEQ ID NO: 210376 - protein, 39 aa, Artificial Sequence
  Description of Artificial Sequence: Synthetic polypeptide
DEACISTTNPVAYEGYGQCVCGNWGEDPNTEGFNSDNQS

SEQ ID NO: 210377 - protein, 39 aa, Artificial Sequence
  Description of Artificial Sequence: Synthetic polypeptide
DEMEIRTTNPCATEGWGQCQTCGNWEEHNAEYSNSETQA

SEQ ID NO: 210378 - protein, 38 aa, Artificial Sequence
  Description of Artificial Sequence: Synthetic polypeptide
DEACISTTNPVAYEGYGQCVCENWGEHNAEFFNSDTQA

SEQ ID NO: 210379 - protein, 39 aa, Artificial Sequence
  Description of Artificial Sequence: Synthetic polypeptide
CEACISTTNPVATEQYGQCVCPNWGEDHNAEHFNSDTQA

SEQ ID NO: 210380 - protein, 39 aa, Artificial Sequence
  Description of Artificial Sequence: Synthetic polypeptide
DEEAISTTNPVAYEGYGQCVCGMWGEDHNAEHFNSDTQI

SEQ ID NO: 210381 - protein, 39 aa, Artificial Sequence
  Description of Artificial Sequence: Synthetic polypeptide
DEMCISTTNPVATEQYGQCVCQMWGADHNIENFMSDTQS

SEQ ID NO: 210382 - protein, 40 aa, Artificial Sequence
  Description of Artificial Sequence: Synthetic polypeptide
CEAEIRTTNPVAYEGYGQCQVCSNWEEDHNAENFNSDTQM

SEQ ID NO: 210383 - protein, 39 aa, Artificial Sequence
  Description of Artificial Sequence: Synthetic polypeptide
DEDEIATTNPVAYEPQWGGCTNAANNGDGTIANPDDNGM

SEQ ID NO: 210384 - protein, 39 aa, Artificial Sequence
  Description of Artificial Sequence: Synthetic polypeptide
DEEAISTTNPVAYEAYGQCVCQNWGEDHNAEHSNSDNQS

SEQ ID NO: 210385 - protein, 39 aa, Artificial Sequence
  Description of Artificial Sequence: Synthetic polypeptide
VEDEIATTNPVAYGEPWGHSISAIADGALTQTNHGDSSV

SEQ ID NO: 210386 - protein, 38 aa, Artificial Sequence
  Description of Artificial Sequence: Synthetic polypeptide
CEAEISCTNPVATEGYGCVCQNWGEDHNAENFNSDTQA

SEQ ID NO: 210387 - protein, 38 aa, Artificial Sequence
  Description of Artificial Sequence: Synthetic polypeptide
CEAEIRTTNPVAYEPWGCAYNQLRPNDKDERNTDKEGR

SEQ ID NO: 210388 - protein, 39 aa, Artificial Sequence
  Description of Artificial Sequence: Synthetic polypeptide
AEECISTTNPVAYEQWGQCVCSNWVEDHNAENFNSETQS

SEQ ID NO: 210389 - protein, 39 aa, Artificial Sequence
  Description of Artificial Sequence: Synthetic polypeptide
DDMCISTTNPVATEGYGQCVCSNWGEDHNIENFNSDTQI

SEQ ID NO: 210390 - protein, 39 aa, Artificial Sequence
  Description of Artificial Sequence: Synthetic polypeptide
DDMCISTTNPVATEGYGQCVCSNWGEGHNAEGFNSDNQP

SEQ ID NO: 210391 - protein, 38 aa, Artificial Sequence
  Description of Artificial Sequence: Synthetic polypeptide
CEAEIRTTNPVAYEPWGCAYNQLRPNDKDERNPDKRGK

SEQ ID NO: 210392 - protein, 39 aa, Artificial Sequence
  Description of Artificial Sequence: Synthetic polypeptide
AEECISTTNPVAYEGYGQCVCSNWMEDHNAENFNSDNQG

SEQ ID NO: 210393 - protein, 39 aa, Artificial Sequence
  Description of Artificial Sequence: Synthetic polypeptide
DDMCISTTNPVATEQYGQCVCGNWGEDTNEENFISDTQS

SEQ ID NO: 210394 - protein, 39 aa, Artificial Sequence
  Description of Artificial Sequence: Synthetic polypeptide
AEECISTTNPVATEQWGQCVCGNSGEDHNAENFISDTQS

SEQ ID NO: 210395 - protein, 39 aa, Artificial Sequence
  Description of Artificial Sequence: Synthetic polypeptide
QEEELYGNPTEPSCATEQYGSMVILVVNQLWVRAVAQDE

SEQ ID NO: 210396 - protein, 39 aa, Artificial Sequence
  Description of Artificial Sequence: Synthetic polypeptide
DDMCISTTNPVAYEEYGQCVCSNWGEGTNAENFNSETQS

SEQ ID NO: 210397 - protein, 39 aa, Artificial Sequence
  Description of Artificial Sequence: Synthetic polypeptide
DEEAISTTNPVAYEEWGQCVCSNWGEDHNAENFNSDTVS

SEQ ID NO: 210398 - protein, 39 aa, Artificial Sequence
  Description of Artificial Sequence: Synthetic polypeptide
DDAEISTTNPVAYEQYGQCYCSNWGEDDNIENFNSDTQS

SEQ ID NO: 210399 - protein, 40 aa, Artificial Sequence
  Description of Artificial Sequence: Synthetic polypeptide
DEEAISTTNPVAYEGYGQCAVCPNWGELDNAENFISDNQA

SEQ ID NO: 210400 - protein, 40 aa, Artificial Sequence
  Description of Artificial Sequence: Synthetic polypeptide
DEACISTTNPVAYEYYGQCQSCSNWGADHNTENFISDNQP

SEQ ID NO: 210401 - protein, 40 aa, Artificial Sequence
  Description of Artificial Sequence: Synthetic polypeptide
CEACISTTNPVATEQYGQCQVCSNWGPDHNAENFNSVTQA

SEQ ID NO: 210402 - protein, 39 aa, Artificial Sequence
  Description of Artificial Sequence: Synthetic polypeptide
AEECISTTNPVATEGYGQCVCSNWGEDHNAENFISETQP

SEQ ID NO: 210403 - protein, 39 aa, Artificial Sequence
  Description of Artificial Sequence: Synthetic polypeptide
CDEEISTTNPVAYEGYGQCVCSNWGEDHNAENFGSDFQA

SEQ ID NO: 210404 - protein, 39 aa, Artificial Sequence
  Description of Artificial Sequence: Synthetic polypeptide
DDMEISCTNPVAYEQYGQCVCSMWEEDHNAESFNSDNQS

SEQ ID NO: 210405 - protein, 39 aa, Artificial Sequence
  Description of Artificial Sequence: Synthetic polypeptide
DDMEISCTNPVAYEQYGQCVCSNWGEDHNAENFNSDTQG

SEQ ID NO: 210406 - protein, 39 aa, Artificial Sequence
  Description of Artificial Sequence: Synthetic polypeptide
DDMEISCTNPVAYEQYGQCVCSNWGEEHNAENFNSDNQN

SEQ ID NO: 210407 - protein, 39 aa, Artificial Sequence
  Description of Artificial Sequence: Synthetic polypeptide
AEECISTTNPVAYEGYGQCVCSNWGEDHNAEGSNSDTQA

SEQ ID NO: 210408 - protein, 38 aa, Artificial Sequence
  Description of Artificial Sequence: Synthetic polypeptide
DDMEISTTNPCAYEQYGQCVCQNWGEHNAENFNSETQF

SEQ ID NO: 210409 - protein, 39 aa, Artificial Sequence
  Description of Artificial Sequence: Synthetic polypeptide
CDEEISTTNPVAYEGYGQCVCSNWEEDHNAESFQSDTQA

SEQ ID NO: 210410 - protein, 37 aa, Artificial Sequence
  Description of Artificial Sequence: Synthetic polypeptide
CEDEIATTNPVAYEPWGRPAPAGQGPALTHQDGMQAV

SEQ ID NO: 210411 - protein, 37 aa, Artificial Sequence
  Description of Artificial Sequence: Synthetic polypeptide
VEDEIATTNPVAYEQWGTNCAATAGEHPDSMGPGEAG

SEQ ID NO: 210412 - protein, 39 aa, Artificial Sequence
  Description of Artificial Sequence: Synthetic polypeptide
DEACISTTNPVAYCQYGQCVCSNSGEDHNAENFQSDTQS

SEQ ID NO: 210413 - protein, 38 aa, Artificial Sequence
  Description of Artificial Sequence: Synthetic polypeptide
DEDEIATTNPVAYEPWGRPPPAGQGPALQMHQDGQEAV

SEQ ID NO: 210414 - protein, 39 aa, Artificial Sequence
  Description of Artificial Sequence: Synthetic polypeptide
VEDEIATTNPVAYEPWGHYVSAIADGALTQTNHGDSSDG

SEQ ID NO: 210415 - protein, 39 aa, Artificial Sequence
  Description of Artificial Sequence: Synthetic polypeptide
DEACISTTNPVATEYYGQCVCENWGEDHNAENFNSDNQP

SEQ ID NO: 210416 - protein, 39 aa, Artificial Sequence
  Description of Artificial Sequence: Synthetic polypeptide
VEDEIATTNPVAYEPWGHSVSAIADGAETATRHGDSSVM

SEQ ID NO: 210417 - protein, 38 aa, Artificial Sequence
  Description of Artificial Sequence: Synthetic polypeptide
DEDEIATTNPVAYEPWGRPPPAGQGPALQTHQDGMWAV

SEQ ID NO: 210418 - protein, 39 aa, Artificial Sequence
  Description of Artificial Sequence: Synthetic polypeptide
DDMEISCTNPVAYEEYGQCVCSNWNEGTNAENFNSETQS

SEQ ID NO: 210419 - protein, 40 aa, Artificial Sequence
  Description of Artificial Sequence: Synthetic polypeptide
DEEPAIVRTTNPVAYDAYGIVVVWCAPMQSQSHPMGNTNE

SEQ ID NO: 210420 - protein, 37 aa, Artificial Sequence
  Description of Artificial Sequence: Synthetic polypeptide
DEDEIATTNPVAYEPWGRPPPAGQGPALNHHDGMEAL

SEQ ID NO: 210421 - protein, 38 aa, Artificial Sequence
  Description of Artificial Sequence: Synthetic polypeptide
DEDEIATTNPVAYEPWGRPPPAGQGPAGTAHQDGMEAV

SEQ ID NO: 210422 - protein, 39 aa, Artificial Sequence
  Description of Artificial Sequence: Synthetic polypeptide
CEACISTTNPVATEGYGQCVCSNSGEDHNAENFNSDTQS

SEQ ID NO: 210423 - protein, 38 aa, Artificial Sequence
  Description of Artificial Sequence: Synthetic polypeptide
DDAEISTVNPVAYEGYGQCVCSNWGEHNAEHFNSDNQS

SEQ ID NO: 210424 - protein, 39 aa, Artificial Sequence
  Description of Artificial Sequence: Synthetic polypeptide
AEECISTTNPVAYEGYGQCVCSNWGEDHNAENSISDNQS

SEQ ID NO: 210425 - protein, 39 aa, Artificial Sequence
  Description of Artificial Sequence: Synthetic polypeptide
CEACIRTTNPCATEGYGQCVCSNWGEDHNAENFNSDTQS

SEQ ID NO: 210426 - protein, 40 aa, Artificial Sequence
  Description of Artificial Sequence: Synthetic polypeptide
DEMEISTTNPVAYEGYGQCAVCSNWEEDHNAENFLSEFQS

SEQ ID NO: 210427 - protein, 39 aa, Artificial Sequence
  Description of Artificial Sequence: Synthetic polypeptide
AEECISTTNPVATEGYGQCVCPNWGEDHNAEYFNSDTQS

SEQ ID NO: 210428 - protein, 38 aa, Artificial Sequence
  Description of Artificial Sequence: Synthetic polypeptide
DEACISTTNPVAYEGYGCVCQNWGEDHNAENFNSQFQS

SEQ ID NO: 210429 - protein, 39 aa, Artificial Sequence
  Description of Artificial Sequence: Synthetic polypeptide
DEACISTTNPVAYEEYGQCVCSNWGEDPNAENFNSDTQS

SEQ ID NO: 210430 - protein, 38 aa, Artificial Sequence
  Description of Artificial Sequence: Synthetic polypeptide
CEAAISTTNPVAYEAYGCVCSNWGEDHNAENFNSDTQA

SEQ ID NO: 210431 - protein, 39 aa, Artificial Sequence
  Description of Artificial Sequence: Synthetic polypeptide
DEACISTTNPVAYEEYGQCVCSNWGEDHNTENFISDTQA

SEQ ID NO: 210432 - protein, 40 aa, Artificial Sequence
  Description of Artificial Sequence: Synthetic polypeptide
AEECISTTNPVATEGYGQCQVCSNWGEPHNAENFNSEFQS

SEQ ID NO: 210433 - protein, 39 aa, Artificial Sequence
  Description of Artificial Sequence: Synthetic polypeptide
DEMEISTTNPVAYEGWGQCVCSNSGEDHNAENFNSDNQA

SEQ ID NO: 210434 - protein, 39 aa, Artificial Sequence
  Description of Artificial Sequence: Synthetic polypeptide
DEACISTTNPVAYEEYGQCVCSMSGEDDNAENFNSDTQA

SEQ ID NO: 210435 - protein, 37 aa, Artificial Sequence
  Description of Artificial Sequence: Synthetic polypeptide
DEDEIATTNPVAYEPWGRPPPAGQGPAEQHQDGAEAV

SEQ ID NO: 210436 - protein, 38 aa, Artificial Sequence
  Description of Artificial Sequence: Synthetic polypeptide
CDMEISTTNPVAYEQYGCVCSNWGEDHNAENFISDFQA

SEQ ID NO: 210437 - protein, 38 aa, Artificial Sequence
  Description of Artificial Sequence: Synthetic polypeptide
DEDEIATTNPVAYEPWGRPPPAGQGPALDVHQDGMEAV

SEQ ID NO: 210438 - protein, 39 aa, Artificial Sequence
  Description of Artificial Sequence: Synthetic polypeptide
AEECISTTNPVAYEGYGCQVCSNWEEDHNIENFNSDPQA

SEQ ID NO: 210439 - protein, 39 aa, Artificial Sequence
  Description of Artificial Sequence: Synthetic polypeptide
DDAEISTTNPVAYEQYGQCVCSNWGEDHNDENFISDTQA

SEQ ID NO: 210440 - protein, 39 aa, Artificial Sequence
  Description of Artificial Sequence: Synthetic polypeptide
DEACISTTNPVAYEQYGQCVCSNWGEDHNAENFSSETQS

SEQ ID NO: 210441 - protein, 39 aa, Artificial Sequence
  Description of Artificial Sequence: Synthetic polypeptide
AEECISTTNPVAYEQYGQCVCSNWEEDHNAENFISDTQA

SEQ ID NO: 210442 - protein, 38 aa, Artificial Sequence
  Description of Artificial Sequence: Synthetic polypeptide
DEDEIATTNPVAYAPWGTACAATAGELGPDSLASNPRN

SEQ ID NO: 210443 - protein, 36 aa, Artificial Sequence
  Description of Artificial Sequence: Synthetic polypeptide
DEDEIATTNPVAYAPWGTACAAIAGELPDSASNPKN

SEQ ID NO: 210444 - protein, 39 aa, Artificial Sequence
  Description of Artificial Sequence: Synthetic polypeptide
DEACISTTNPVAYEGYGQCVCSNWMEDHNAENFNSDTQS

SEQ ID NO: 210445 - protein, 39 aa, Artificial Sequence
  Description of Artificial Sequence: Synthetic polypeptide
DEMEISTTNPVAYEGYGQCICSNWGEDHNTEGFNSDTQA

SEQ ID NO: 210446 - protein, 37 aa, Artificial Sequence
  Description of Artificial Sequence: Synthetic polypeptide
DEDEIATTNPVAYAPWGPTACAATAGELPDSASNPKF

SEQ ID NO: 210447 - protein, 38 aa, Artificial Sequence
  Description of Artificial Sequence: Synthetic polypeptide
DEDEIATTNPVAYAPWGHTTACAATAGELPDSASNPRM

SEQ ID NO: 210448 - protein, 40 aa, Artificial Sequence
  Description of Artificial Sequence: Synthetic polypeptide
AEECISTTNPVAYEQYGQCQVCSNWGEDPNTEYFNSDNQA

SEQ ID NO: 210449 - protein, 39 aa, Artificial Sequence
  Description of Artificial Sequence: Synthetic polypeptide
DEMCISTTNPVAYEGYGQCVCSNWGEDHNAEHFNSDFQS

SEQ ID NO: 210450 - protein, 39 aa, Artificial Sequence
  Description of Artificial Sequence: Synthetic polypeptide
AEECISTTNPVAYEQYGQCVCSNWGEDHNAENFISDTQS

SEQ ID NO: 210451 - protein, 39 aa, Artificial Sequence
  Description of Artificial Sequence: Synthetic polypeptide
AEECISTTNPVAYEQYGQCVCSNWGEDHNAENFMSETQQ

SEQ ID NO: 210452 - protein, 40 aa, Artificial Sequence
  Description of Artificial Sequence: Synthetic polypeptide
DEMEISTTNPVAYEGYGQCQVCSNWMEDHNAENFNSETQA

SEQ ID NO: 210453 - protein, 37 aa, Artificial Sequence
  Description of Artificial Sequence: Synthetic polypeptide
DDSEVASTNPVSTEGYGCVCGNWGEDNQEGFGSQTQA

SEQ ID NO: 210454 - protein, 40 aa, Artificial Sequence
  Description of Artificial Sequence: Synthetic polypeptide
DEMCISTTNPVAYEQYGQCAVCSNWEEDHNAEYFNSDTQA

SEQ ID NO: 210455 - protein, 39 aa, Artificial Sequence
  Description of Artificial Sequence: Synthetic polypeptide
AEECISTTNPVAYEEYGQCVCSNWMEAHNAENFNSETQA

SEQ ID NO: 210456 - protein, 39 aa, Artificial Sequence
  Description of Artificial Sequence: Synthetic polypeptide
AEECISTTNPVAYEQYGQCVCQNWGEAHNAENFISETQA

SEQ ID NO: 210457 - protein, 39 aa, Artificial Sequence
  Description of Artificial Sequence: Synthetic polypeptide
DEACISTTNPVAYEGYGQCVCSNWGEGHNAEGFNSDNQA

SEQ ID NO: 210458 - protein, 37 aa, Artificial Sequence
  Description of Artificial Sequence: Synthetic polypeptide
DEDEIATTNPVAYAPWGTFACAATAGELPDSASNPYN

SEQ ID NO: 210459 - protein, 38 aa, Artificial Sequence
  Description of Artificial Sequence: Synthetic polypeptide
DEDEIATTNPVAYAPWGTFACAATAGELPDSLASNNRN

SEQ ID NO: 210460 - protein, 39 aa, Artificial Sequence
  Description of Artificial Sequence: Synthetic polypeptide
AEECISTTNPVAYEQYGQCVCPNWGEDHNAENFQSDTQS

SEQ ID NO: 210461 - protein, 39 aa, Artificial Sequence
  Description of Artificial Sequence: Synthetic polypeptide
AEECISTTNPVAYEQYGQCVCPNWGEDHNAENFSSDTQA

SEQ ID NO: 210462 - protein, 39 aa, Artificial Sequence
  Description of Artificial Sequence: Synthetic polypeptide
DDAEISTTNPVAYEQYGQCVCNNWGEDHNAEFFISDTQS

SEQ ID NO: 210463 - protein, 39 aa, Artificial Sequence
  Description of Artificial Sequence: Synthetic polypeptide
DEMCISTTNPVAYEGYGQCVCSNWGEDPNAENFNSDNQS

SEQ ID NO: 210464 - protein, 39 aa, Artificial Sequence
  Description of Artificial Sequence: Synthetic polypeptide
AEECISTTNPVAYEQYGQCVCGNWGEEDNTENFNSDPQA

SEQ ID NO: 210465 - protein, 40 aa, Artificial Sequence
  Description of Artificial Sequence: Synthetic polypeptide
AEECISTTNPVAYEQYGQCQVCSNWGEPDNAENFNSEFQS

SEQ ID NO: 210466 - protein, 39 aa, Artificial Sequence
  Description of Artificial Sequence: Synthetic polypeptide
DEACISTTNPVAYEQYGQCVCGNWGEDHNAENSNSDTQS

SEQ ID NO: 210467 - protein, 39 aa, Artificial Sequence
  Description of Artificial Sequence: Synthetic polypeptide
DEACISTTNPVAYEQYGQCVCGNWGEDDNAEFFNSDTQS

SEQ ID NO: 210468 - protein, 39 aa, Artificial Sequence
  Description of Artificial Sequence: Synthetic polypeptide
DEACISTTNPVAYEQYGQCVCGNSGEDHNAENFISDTQS

SEQ ID NO: 210469 - protein, 39 aa, Artificial Sequence
  Description of Artificial Sequence: Synthetic polypeptide
DDAEISTTNPVAYEQYGQCVCGNWEEDHNAEHFGSETQA

SEQ ID NO: 210470 - protein, 40 aa, Artificial Sequence
  Description of Artificial Sequence: Synthetic polypeptide
DEACISTTNPVAYEQYGQCAVCSNWEEDHNAEYFNSETQA

SEQ ID NO: 210471 - protein, 39 aa, Artificial Sequence
  Description of Artificial Sequence: Synthetic polypeptide
DEMCISTTNPVAYEQWGQCVCSNWGEDHNAENFNSDTQQ

SEQ ID NO: 210472 - protein, 40 aa, Artificial Sequence
  Description of Artificial Sequence: Synthetic polypeptide
DEMEISTTNPVAYEGYGQCQVCGNSGEDDNTENFISETQA

SEQ ID NO: 210473 - protein, 38 aa, Artificial Sequence
  Description of Artificial Sequence: Synthetic polypeptide
DEACISTTNPVAYEQYGCICSNWGEDDNEEYFPSDTQS

SEQ ID NO: 210474 - protein, 39 aa, Artificial Sequence
  Description of Artificial Sequence: Synthetic polypeptide
DEACISTTNPVAYEQWGQCVCSMWEEDHNDENFNSDTQA

SEQ ID NO: 210475 - protein, 39 aa, Artificial Sequence
  Description of Artificial Sequence: Synthetic polypeptide
AEECISTTNPVAYEAYGQCVCSNWGEDHNAENFNSDTQG

SEQ ID NO: 210476 - protein, 39 aa, Artificial Sequence
  Description of Artificial Sequence: Synthetic polypeptide
DEACISTTNPVAYEGYGQCVCSNWGEDHNTENFISDTQF

SEQ ID NO: 210477 - protein, 39 aa, Artificial Sequence
  Description of Artificial Sequence: Synthetic polypeptide
DEACISTTNPVAYEGYGQCVCSNWGEDHNIEYFNSDTQG

SEQ ID NO: 210478 - protein, 39 aa, Artificial Sequence
  Description of Artificial Sequence: Synthetic polypeptide
DEDEIATTNPVAYAPIWGHAVSAINTGEPTQGPQDNHSM

SEQ ID NO: 210479 - protein, 38 aa, Artificial Sequence
  Description of Artificial Sequence: Synthetic polypeptide
CEAEISTTNPVAYEGYGCVCPNWGEDHNAENFNSDNQA

SEQ ID NO: 210480 - protein, 39 aa, Artificial Sequence
  Description of Artificial Sequence: Synthetic polypeptide
DESEIRCTNCVATEAYGAAGNNAGDDNDGEQNGMEGAQQ

SEQ ID NO: 210481 - protein, 39 aa, Artificial Sequence
  Description of Artificial Sequence: Synthetic polypeptide
DESEIRCTNCVATEAYGAIGNNAGDDNDGEQGGMEGAQG

SEQ ID NO: 210482 - protein, 39 aa, Artificial Sequence
  Description of Artificial Sequence: Synthetic polypeptide
DEACISTTNPVAYEQYGQCVCPNWGEDHNAEYFNSDNQS

SEQ ID NO: 210483 - protein, 38 aa, Artificial Sequence
  Description of Artificial Sequence: Synthetic polypeptide
CEAEISTTNPVAYEGYGCVCGNWGEDHNAENFNSDTQA

SEQ ID NO: 210484 - protein, 39 aa, Artificial Sequence
  Description of Artificial Sequence: Synthetic polypeptide
DDAEISTTNPVAYEQYGQCVCSNWEEDHNAEGFISDTQS

SEQ ID NO: 210485 - protein, 40 aa, Artificial Sequence
  Description of Artificial Sequence: Synthetic polypeptide
CEAEISTTNPVATEGYGQCQVCSNWGEGHNTENFISDTQA

SEQ ID NO: 210486 - protein, 40 aa, Artificial Sequence
  Description of Artificial Sequence: Synthetic polypeptide
CEAEISTTNPVATEGYGQCQVCGTWGEDDNAEYFNSDTQS

SEQ ID NO: 210487 - protein, 39 aa, Artificial Sequence
  Description of Artificial Sequence: Synthetic polypeptide
DDAEISTTNPVAYEQYGQCVCSNWGEDHNAENFSSETQS

SEQ ID NO: 210488 - protein, 40 aa, Artificial Sequence
  Description of Artificial Sequence: Synthetic polypeptide
CEAEISTTNPCAYEQYGQCQVCSTWGEDHNAEYFNSDPQI

SEQ ID NO: 210489 - protein, 39 aa, Artificial Sequence
  Description of Artificial Sequence: Synthetic polypeptide
AEECISTTNPVAYEGYGCIVCSNWGEDHNTENFNSETQA

SEQ ID NO: 210490 - protein, 39 aa, Artificial Sequence
  Description of Artificial Sequence: Synthetic polypeptide
DEACISTTNPVAYEQYGQCVCSNWGEDHNAENFISDTQA

SEQ ID NO: 210491 - protein, 39 aa, Artificial Sequence
  Description of Artificial Sequence: Synthetic polypeptide
DEACISTTNPVAYEQYGQCVCSNWGEDHNAENFISDTQS

SEQ ID NO: 210492 - protein, 39 aa, Artificial Sequence
  Description of Artificial Sequence: Synthetic polypeptide
CEAEISCTNPVAYEQYGQCVCSNWGEDHNAENFNSDTQA

SEQ ID NO: 210493 - protein, 38 aa, Artificial Sequence
  Description of Artificial Sequence: Synthetic polypeptide
VEDEIATTNPVAYYEQPYVATPAATGGEDTGTPGGSAE

SEQ ID NO: 210494 - protein, 39 aa, Artificial Sequence
  Description of Artificial Sequence: Synthetic polypeptide
DDAEISTTNPVAYEQYGQCVCSNWEEDHNAEFFPSDTQA

SEQ ID NO: 210495 - protein, 39 aa, Artificial Sequence
  Description of Artificial Sequence: Synthetic polypeptide
DEMCISTTNPVAYEGYGQCSCSMWGEDHNAENFNSENQS

SEQ ID NO: 210496 - protein, 39 aa, Artificial Sequence
  Description of Artificial Sequence: Synthetic polypeptide
DEACISTTNPVAYEGYGQCVCSMWEEDDNAENFNSDNQA

SEQ ID NO: 210497 - protein, 38 aa, Artificial Sequence
  Description of Artificial Sequence: Synthetic polypeptide
CEAEISTTNPVAYEGYGQCVCSNWGEDHNANFNSDTQA

SEQ ID NO: 210498 - protein, 39 aa, Artificial Sequence
  Description of Artificial Sequence: Synthetic polypeptide
DEACISTTNPVAYEGYGQCVCSNWGEDHNIESFSSENQS

SEQ ID NO: 210499 - protein, 39 aa, Artificial Sequence
  Description of Artificial Sequence: Synthetic polypeptide
DEMEISTTNPVAYEGYGQCVCGNWGEDHNAEYFNSENQA

SEQ ID NO: 210500 - protein, 40 aa, Artificial Sequence
  Description of Artificial Sequence: Synthetic polypeptide
VEEEIATTNPVAYYEPQWGSPFAALAGPGGEPDANPPGAH

SEQ ID NO: 210501 - protein, 41 aa, Artificial Sequence
  Description of Artificial Sequence: Synthetic polypeptide
VEEEIATTNPVAYTYAPQSWGCPAGPPGNTEPANMQENGNN

SEQ ID NO: 210502 - protein, 38 aa, Artificial Sequence
  Description of Artificial Sequence: Synthetic polypeptide
CEAEIVTTNPVAYEPWGCAYNQLRPNDADERKNDKEGR

SEQ ID NO: 210503 - protein, 39 aa, Artificial Sequence
  Description of Artificial Sequence: Synthetic polypeptide
CEAEISTTNPVAYEQYGQCVCSNWGEDDNAENFISDTQA

SEQ ID NO: 210504 - protein, 39 aa, Artificial Sequence
  Description of Artificial Sequence: Synthetic polypeptide
DEACISTTNPVAYEGYGQCVCSNWGEDHNAEYFNSDNQA

SEQ ID NO: 210505 - protein, 39 aa, Artificial Sequence
  Description of Artificial Sequence: Synthetic polypeptide
DDMEISTTNPVAYCQYGQCVCSNWMEDHNAENFNSDNQA

SEQ ID NO: 210506 - protein, 39 aa, Artificial Sequence
  Description of Artificial Sequence: Synthetic polypeptide
DEACISTTNPVAYEGYGQCVCSNWGEDHNAENFLSDNQS

SEQ ID NO: 210507 - protein, 40 aa, Artificial Sequence
  Description of Artificial Sequence: Synthetic polypeptide
CEAEISTTNPVAYEQYGQCQVCSNWEEDHNAEYFNSDTQM

SEQ ID NO: 210508 - protein, 39 aa, Artificial Sequence
  Description of Artificial Sequence: Synthetic polypeptide
DEMCISTTNPVAYEGYGQCVCSDWGEDHNTENFNSDTQS

SEQ ID NO: 210509 - protein, 39 aa, Artificial Sequence
  Description of Artificial Sequence: Synthetic polypeptide
DEMCISTTNPVAYEGYGQCVCSDWGEDHNAENFNSDNQP

SEQ ID NO: 210510 - protein, 39 aa, Artificial Sequence
  Description of Artificial Sequence: Synthetic polypeptide
DEACISTTNPVAYEGYGQCVCSNWGADHNAENFNSDTQA

SEQ ID NO: 210511 - protein, 39 aa, Artificial Sequence
  Description of Artificial Sequence: Synthetic polypeptide
AEECISTTNPVAYEQYGQCICGNSGEAHNAENFISDNQA

SEQ ID NO: 210512 - protein, 38 aa, Artificial Sequence
  Description of Artificial Sequence: Synthetic polypeptide
DEMCISTTNPVAYEGYGQCVCGNWGEHNAENFNSQFQS

SEQ ID NO: 210513 - protein, 39 aa, Artificial Sequence
  Description of Artificial Sequence: Synthetic polypeptide
CEAEISTTNPVAYEGYGQCVCSNWMEDHNAENFNSQTQA

SEQ ID NO: 210514 - protein, 39 aa, Artificial Sequence
  Description of Artificial Sequence: Synthetic polypeptide
DEMCISTTNPVAYEGYGQCVCSNSGEGHNAENFNSDTQS

SEQ ID NO: 210515 - protein, 39 aa, Artificial Sequence
  Description of Artificial Sequence: Synthetic polypeptide
VEDEIATTNPVAYEPWGHSPSAIADGALTQTNHGDSSEG

SEQ ID NO: 210516 - protein, 39 aa, Artificial Sequence
  Description of Artificial Sequence: Synthetic polypeptide
CEAAISTTNPVATEGYGCQVCSNWGEDHNAENFNSDTQA

SEQ ID NO: 210517 - protein, 39 aa, Artificial Sequence
  Description of Artificial Sequence: Synthetic polypeptide
VEDEIATTNPVAYEPIWGHTFACAATAGELPDSGENGRM

SEQ ID NO: 210518 - protein, 39 aa, Artificial Sequence
  Description of Artificial Sequence: Synthetic polypeptide
DDNCISTTNPVAYEQYGQCVCSNWGEPDNTENFISDTQS

SEQ ID NO: 210519 - protein, 40 aa, Artificial Sequence
  Description of Artificial Sequence: Synthetic polypeptide
AEECISTTNPCATEQYGQCQVCSNWGEDHNAEGFNSDNAS

SEQ ID NO: 210520 - protein, 40 aa, Artificial Sequence
  Description of Artificial Sequence: Synthetic polypeptide
DEEQIATTNPVATEQWGCTNNQANGNGVDEATANIDEEWP

SEQ ID NO: 210521 - protein, 39 aa, Artificial Sequence
  Description of Artificial Sequence: Synthetic polypeptide
DDNCISTTNPVAYEGYGICVCSTWGEDHNTENFNSDTQA

SEQ ID NO: 210522 - protein, 39 aa, Artificial Sequence
  Description of Artificial Sequence: Synthetic polypeptide
AEECISCTNPVAYEQYGQCVCSNWEEDHNAENFQSDTQA

SEQ ID NO: 210523 - protein, 39 aa, Artificial Sequence
  Description of Artificial Sequence: Synthetic polypeptide
AEECISTTNPEATEGYGQCVCSNWGEDHNAENFNSDTQS

SEQ ID NO: 210524 - protein, 38 aa, Artificial Sequence
  Description of Artificial Sequence: Synthetic polypeptide
CDEEISCTNPVAYEGYGCVCSNWEEDHNAESFNSDTQA

SEQ ID NO: 210525 - protein, 38 aa, Artificial Sequence
  Description of Artificial Sequence: Synthetic polypeptide
AEECISCTNPVAYEGYGQCVCSNWGEHNAENFISENQL

SEQ ID NO: 210526 - protein, 39 aa, Artificial Sequence
  Description of Artificial Sequence: Synthetic polypeptide
CDAEISTTNPVATEGYGICVCSNWGEDHNAENFNSDTQA

SEQ ID NO: 210527 - protein, 38 aa, Artificial Sequence
  Description of Artificial Sequence: Synthetic polypeptide
DDNCISTTNPVAYEGYGCVCSNWGEDHNAEYFNSDTQS

SEQ ID NO: 210528 - protein, 39 aa, Artificial Sequence
  Description of Artificial Sequence: Synthetic polypeptide
DDAEISTTNPVAYEGYGQCVCSNWGEDHNAEYFNSDNQS

SEQ ID NO: 210529 - protein, 39 aa, Artificial Sequence
  Description of Artificial Sequence: Synthetic polypeptide
DDAEISTTNPVAYEGYGQCVCSNWGEDHNAENFGSETQA

SEQ ID NO: 210530 - protein, 39 aa, Artificial Sequence
  Description of Artificial Sequence: Synthetic polypeptide
DDNCISTTNPVATEGYGQCVCSNWGEDDNAEHFNSDTQS

SEQ ID NO: 210531 - protein, 39 aa, Artificial Sequence
  Description of Artificial Sequence: Synthetic polypeptide
DDNCISTTNPVATEGYGQCVCSNWEEDDNAEHFNSDNQS

SEQ ID NO: 210532 - protein, 40 aa, Artificial Sequence
  Description of Artificial Sequence: Synthetic polypeptide
DDNCIRTTNPVATEGYGQCAVCSNWEEDHNAENFNSEFQS

SEQ ID NO: 210533 - protein, 39 aa, Artificial Sequence
  Description of Artificial Sequence: Synthetic polypeptide
DDAEISTTNPVAYEGYGQCVCSNWGEDHNAENFGSDTQA

SEQ ID NO: 210534 - protein, 38 aa, Artificial Sequence
  Description of Artificial Sequence: Synthetic polypeptide
DEDEIATTNPVAYEPWVRPPPAGQGPALQNHQDGMEAV

SEQ ID NO: 210535 - protein, 39 aa, Artificial Sequence
  Description of Artificial Sequence: Synthetic polypeptide
VEDEIATTNPVAYAPWGHSFVSAIADGALTNTRHGDETG

SEQ ID NO: 210536 - protein, 40 aa, Artificial Sequence
  Description of Artificial Sequence: Synthetic polypeptide
VEDEIATTNPVAYAPWGHSFVSAIADGALTQTRHGDSMDG

SEQ ID NO: 210537 - protein, 37 aa, Artificial Sequence
  Description of Artificial Sequence: Synthetic polypeptide
VEDEIATTNPVAYAPWGTFACAATAGELPDSGQNPMF

SEQ ID NO: 210538 - protein, 39 aa, Artificial Sequence
  Description of Artificial Sequence: Synthetic polypeptide
DDMEISTTNPVAYEQYGQCVCSNWGEDHNAENFISEFQA

SEQ ID NO: 210539 - protein, 39 aa, Artificial Sequence
  Description of Artificial Sequence: Synthetic polypeptide
VEDEIATTNPVAYDPWGHSFVSAIADGALTQTNHGDSSF

SEQ ID NO: 210540 - protein, 40 aa, Artificial Sequence
  Description of Artificial Sequence: Synthetic polypeptide
DEACISTTNPVATEQYGQCQYCSNWGEDHNAENFNSDTQS

SEQ ID NO: 210541 - protein, 37 aa, Artificial Sequence
  Description of Artificial Sequence: Synthetic polypeptide
DEAEIACTNPVATEQWGCIWNAAMNTEEADPSMSEGQ

SEQ ID NO: 210542 - protein, 39 aa, Artificial Sequence
  Description of Artificial Sequence: Synthetic polypeptide
DDAEISTTNPVAYEGYGQCVCSNWGEDDNAENFNSDTQP

SEQ ID NO: 210543 - protein, 39 aa, Artificial Sequence
  Description of Artificial Sequence: Synthetic polypeptide
DDNEISCTNPVATEGYGQCVCSNSGEDHNAENFSSDNQA

SEQ ID NO: 210544 - protein, 39 aa, Artificial Sequence
  Description of Artificial Sequence: Synthetic polypeptide
VEDEIATTNPVAYEPPWGHSNIAATAWDLPAGKSGNDTW

SEQ ID NO: 210545 - protein, 39 aa, Artificial Sequence
  Description of Artificial Sequence: Synthetic polypeptide
CDECISTTNPVAYEQYGQCVCSMSGEDHNAENFGSDTQA

SEQ ID NO: 210546 - protein, 39 aa, Artificial Sequence
  Description of Artificial Sequence: Synthetic polypeptide
DDAEISTTNPVAYEGYGQCVCSNWGEDHNIEYFNSDTQA

SEQ ID NO: 210547 - protein, 39 aa, Artificial Sequence
  Description of Artificial Sequence: Synthetic polypeptide
DDEEISTTNPVAYEHYGQCVCSMWGEDHNIEFFISQTQS

SEQ ID NO: 210548 - protein, 39 aa, Artificial Sequence
  Description of Artificial Sequence: Synthetic polypeptide
VEDEIASTNPVAYEPWGHSVSAIADGALTQTNHGDSSDM

SEQ ID NO: 210549 - protein, 39 aa, Artificial Sequence
  Description of Artificial Sequence: Synthetic polypeptide
DDEEISTTNPVAYEGYGQCVCSMWGEDHNAENFISDTQF

SEQ ID NO: 210550 - protein, 39 aa, Artificial Sequence
  Description of Artificial Sequence: Synthetic polypeptide
DEEAISTTNPCAYEEYGQCVCSNWGEDHNAENFLSDTQS

SEQ ID NO: 210551 - protein, 39 aa, Artificial Sequence
  Description of Artificial Sequence: Synthetic polypeptide
CEECIACTNPVATEQWGGCVGAGNNGMTQTAMQEGSDHM

SEQ ID NO: 210552 - protein, 38 aa, Artificial Sequence
  Description of Artificial Sequence: Synthetic polypeptide
DEDEIATTNPVAYEPWGRPPPCAGQGPALTHQDGMEAV

SEQ ID NO: 210553 - protein, 40 aa, Artificial Sequence
  Description of Artificial Sequence: Synthetic polypeptide
DDAEISTTNPVAYEHYGQCQSCSNWMELPNAEGFNSDNQS

SEQ ID NO: 210554 - protein, 40 aa, Artificial Sequence
  Description of Artificial Sequence: Synthetic polypeptide
AEECISTTNPCATEQYGQCQVCSNWGEDHNAEHFNSDTQS

SEQ ID NO: 210555 - protein, 39 aa, Artificial Sequence
  Description of Artificial Sequence: Synthetic polypeptide
CDAEISTTNPVAYEQYGQCVCSNWGEDHNAEHFNSDTQM

SEQ ID NO: 210556 - protein, 39 aa, Artificial Sequence
  Description of Artificial Sequence: Synthetic polypeptide
DDAEISTTNPVAYEGYGQCVCSNWVEDHNAENFNSDPQL

SEQ ID NO: 210557 - protein, 36 aa, Artificial Sequence
  Description of Artificial Sequence: Synthetic polypeptide
VEDEIACTNPVAYEQWGCCAQGGNGEATAHGDGEFT

SEQ ID NO: 210558 - protein, 37 aa, Artificial Sequence
  Description of Artificial Sequence: Synthetic polypeptide
VEDEIACTNPVAYEQWGSVCAADIPAWIDVGDPMESW

SEQ ID NO: 210559 - protein, 38 aa, Artificial Sequence
  Description of Artificial Sequence: Synthetic polypeptide
CDAEISTTNPVAYEEYGCVCSNWGEDHNAENFNSDTQA

SEQ ID NO: 210560 - protein, 37 aa, Artificial Sequence
  Description of Artificial Sequence: Synthetic polypeptide
VEDEIACTNPVAYEQWGTIFAATPGEPDTAGGGNLHK

SEQ ID NO: 210561 - protein, 38 aa, Artificial Sequence
  Description of Artificial Sequence: Synthetic polypeptide
CDAEISTTNPVATEQYGCFCYNWGEDHNTENFNSDTQS

SEQ ID NO: 210562 - protein, 40 aa, Artificial Sequence
  Description of Artificial Sequence: Synthetic polypeptide
DDMEISTTNPVAYEQYGQCQVCSDWGYDHNAENFNSETQS

SEQ ID NO: 210563 - protein, 37 aa, Artificial Sequence
  Description of Artificial Sequence: Synthetic polypeptide
VEDEIACTNPVAYEQWGTISAGPPPEPDTAGGPNDNF

SEQ ID NO: 210564 - protein, 38 aa, Artificial Sequence
  Description of Artificial Sequence: Synthetic polypeptide
DEAEIACTNPVATEQWGCIWNAAMNNDEADPSASEGGN

SEQ ID NO: 210565 - protein, 39 aa, Artificial Sequence
  Description of Artificial Sequence: Synthetic polypeptide
DDAEISTTNPVAYEGYGQCVCSNWGEEHNAENFNSDNQN

SEQ ID NO: 210566 - protein, 39 aa, Artificial Sequence
  Description of Artificial Sequence: Synthetic polypeptide
DDAEISTTNPVAYEGYGQCVCSNWGEEDNTENFNSDTQA

SEQ ID NO: 210567 - protein, 40 aa, Artificial Sequence
  Description of Artificial Sequence: Synthetic polypeptide
DDMEISTTNPVAYEGYGQCAVCSTWGEDDNAENFISDNQS

SEQ ID NO: 210568 - protein, 39 aa, Artificial Sequence
  Description of Artificial Sequence: Synthetic polypeptide
DDEEISTTNPVAYEGYGQCVCSNWGEDHNAEFFISDTQG

SEQ ID NO: 210569 - protein, 38 aa, Artificial Sequence
  Description of Artificial Sequence: Synthetic polypeptide
CDECISTTNPVATEGYGCVCSNWGEDHNAENFMSDFQS

SEQ ID NO: 210570 - protein, 39 aa, Artificial Sequence
  Description of Artificial Sequence: Synthetic polypeptide
CDECISTTNPVATEGYGQCVCSNWEEDHNAESFNSDTQA

SEQ ID NO: 210571 - protein, 39 aa, Artificial Sequence
  Description of Artificial Sequence: Synthetic polypeptide
DDEEISTTNPVAYEGYGQCVCSNWGEDHNAENFISDTQA

SEQ ID NO: 210572 - protein, 39 aa, Artificial Sequence
  Description of Artificial Sequence: Synthetic polypeptide
DDEEISTTNPVAYEGYGQCVCSNWGEDHNQENFISDTQS

SEQ ID NO: 210573 - protein, 39 aa, Artificial Sequence
  Description of Artificial Sequence: Synthetic polypeptide
AEECISTTNPVAYEGYGQCSCSMWGEDDNAENFNSENQS

SEQ ID NO: 210574 - protein, 39 aa, Artificial Sequence
  Description of Artificial Sequence: Synthetic polypeptide
DDEEISTTNPVAYEGYGQCVCSNWGELHNAEFFISETQS

SEQ ID NO: 210575 - protein, 38 aa, Artificial Sequence
  Description of Artificial Sequence: Synthetic polypeptide
DEDEIATTNPVAYEPWGRPPPGAGQGPALQHQDGMLAV

SEQ ID NO: 210576 - protein, 40 aa, Artificial Sequence
  Description of Artificial Sequence: Synthetic polypeptide
DEACISTTNPVATEQYGQCAVCGNWEEDHNAEYFFSETQA

SEQ ID NO: 210577 - protein, 39 aa, Artificial Sequence
  Description of Artificial Sequence: Synthetic polypeptide
DDAEISTTNPVAYEGYGQCVCSNWGEGHNAEGFNSDTQS

SEQ ID NO: 210578 - protein, 38 aa, Artificial Sequence
  Description of Artificial Sequence: Synthetic polypeptide
DDNEISTTNPCAYEGYGCVCSNWMEDHNAENFNSDPQS

SEQ ID NO: 210579 - protein, 39 aa, Artificial Sequence
  Description of Artificial Sequence: Synthetic polypeptide
DEEAISTTNPCSYEGYGQCSCSTWGEDHNIEFFNSDTQS

SEQ ID NO: 210580 - protein, 39 aa, Artificial Sequence
  Description of Artificial Sequence: Synthetic polypeptide
DDMEISTTNPVAYEQWGQCVCSNWVEDHNAENFNSETQS

SEQ ID NO: 210581 - protein, 40 aa, Artificial Sequence
  Description of Artificial Sequence: Synthetic polypeptide
VEDEIATTNPVAYEPWGHSFPSAIADGALTQTNHGDSMRH

SEQ ID NO: 210582 - protein, 40 aa, Artificial Sequence
  Description of Artificial Sequence: Synthetic polypeptide
DEQEIATTNPVATEQWGCYVNAAGTGHGGEATANGISEEE

SEQ ID NO: 210583 - protein, 40 aa, Artificial Sequence
  Description of Artificial Sequence: Synthetic polypeptide
AEECISCTNPVATEQYGQCQVCSNWGEDHNAENSNSDTQS

SEQ ID NO: 210584 - protein, 39 aa, Artificial Sequence
  Description of Artificial Sequence: Synthetic polypeptide
VEDEIACTNPVATEQWGCNVVATGTGGLIIESLDGADQE

SEQ ID NO: 210585 - protein, 39 aa, Artificial Sequence
  Description of Artificial Sequence: Synthetic polypeptide
AEECISTTNPVAYEGYGQCVCSNWGEDDNAEGFNSENQA

SEQ ID NO: 210586 - protein, 39 aa, Artificial Sequence
  Description of Artificial Sequence: Synthetic polypeptide
DEDEIATTNPVAYEPWGRPPPTAGQGPALQQHQMGMEAV

SEQ ID NO: 210587 - protein, 39 aa, Artificial Sequence
  Description of Artificial Sequence: Synthetic polypeptide
DDMEISTTNPVAYEGYGQCVCSNWGEDHNAEYFNSDTQS

SEQ ID NO: 210588 - protein, 39 aa, Artificial Sequence
  Description of Artificial Sequence: Synthetic polypeptide
CEECISTTNPVAYEQYGQCVCSNWGEDHNAENFISDFQA

SEQ ID NO: 210589 - protein, 39 aa, Artificial Sequence
  Description of Artificial Sequence: Synthetic polypeptide
DSEEIRTTNPVGYEGWGQCVCSNWGEDHNAENFGSVTQS

SEQ ID NO: 210590 - protein, 38 aa, Artificial Sequence
  Description of Artificial Sequence: Synthetic polypeptide
CEDEIATTNPVAYEPWGRPPPAGQGPALTNHQDGMPAV

SEQ ID NO: 210591 - protein, 40 aa, Artificial Sequence
  Description of Artificial Sequence: Synthetic polypeptide
VEDEIATTNPVAYEPWGHSFPSAIADGALTQTRHGDSMQN

SEQ ID NO: 210592 - protein, 39 aa, Artificial Sequence
  Description of Artificial Sequence: Synthetic polypeptide
AEECISCTNPVATEGYGQCVCSNWGEDHNAESFNSDTQS

SEQ ID NO: 210593 - protein, 39 aa, Artificial Sequence
  Description of Artificial Sequence: Synthetic polypeptide
DDNEISTTNPVAYEGYGQCVCSNSMEDHNAEYFNSDNQS

SEQ ID NO: 210594 - protein, 39 aa, Artificial Sequence
  Description of Artificial Sequence: Synthetic polypeptide
AEECISTTNPVAYEGYGQCVCSNWGEDDNAENFNSDTQN

SEQ ID NO: 210595 - protein, 39 aa, Artificial Sequence
  Description of Artificial Sequence: Synthetic polypeptide
AEECISTTNPVAYEGYGQCVCSNSGEDHNAESFNSDTQG

SEQ ID NO: 210596 - protein, 39 aa, Artificial Sequence
  Description of Artificial Sequence: Synthetic polypeptide
AEECISCTNPVATEGYGQCVCSNWGADHNAENFNSDTQA

SEQ ID NO: 210597 - protein, 39 aa, Artificial Sequence
  Description of Artificial Sequence: Synthetic polypeptide
DDMEISTTNPVAYEGYGQCVCSNWEEDHNIENFSSDNQS

SEQ ID NO: 210598 - protein, 39 aa, Artificial Sequence
  Description of Artificial Sequence: Synthetic polypeptide
DDMEISTTNPVAYEGYGQCVCSNSGEDHNAEYFNSDTQS

SEQ ID NO: 210599 - protein, 39 aa, Artificial Sequence
  Description of Artificial Sequence: Synthetic polypeptide
AEECISCTNPVATEGYGQCVCSNSGEDHNAEYFNSDNQS

SEQ ID NO: 210600 - protein, 37 aa, Artificial Sequence
  Description of Artificial Sequence: Synthetic polypeptide
DSSEVASTNPVSYEPWGNVVAANATISQISTGGQNRL

SEQ ID NO: 210601 - protein, 38 aa, Artificial Sequence
  Description of Artificial Sequence: Synthetic polypeptide
DEDEIATTNPVAYEPWGRPPPAGQGPALTDHQDGMEPV

SEQ ID NO: 210602 - protein, 40 aa, Artificial Sequence
  Description of Artificial Sequence: Synthetic polypeptide
DEACISTTNPVATEQWGQCQVCSNWGEDDNTENFNSETQL

SEQ ID NO: 210603 - protein, 38 aa, Artificial Sequence
  Description of Artificial Sequence: Synthetic polypeptide
DEDEIATTNPVAYEPWGRPPPAGQGPALSQHQDGMEAN

SEQ ID NO: 210604 - protein, 39 aa, Artificial Sequence
  Description of Artificial Sequence: Synthetic polypeptide
DDMEISTTNPVAYEGYGQCVCSMWGEDHNAENFISQNQS

SEQ ID NO: 210605 - protein, 40 aa, Artificial Sequence
  Description of Artificial Sequence: Synthetic polypeptide
VEDEIATTNPVAYEPWGHSFVSAIADGALTQTNHGDSSDP

SEQ ID NO: 210606 - protein, 39 aa, Artificial Sequence
  Description of Artificial Sequence: Synthetic polypeptide
DEACISTTNPVATEGYGQCYCGNWGEDHNQENFNSDTQS

SEQ ID NO: 210607 - protein, 39 aa, Artificial Sequence
  Description of Artificial Sequence: Synthetic polypeptide
DDMEISTTNPVAYEGYGQCVCSNWGADHNAENFNSDNQA

SEQ ID NO: 210608 - protein, 37 aa, Artificial Sequence
  Description of Artificial Sequence: Synthetic polypeptide
DSSEVASTNPTSYEPYGKVVAANATISQMSTGGMNRL

SEQ ID NO: 210609 - protein, 39 aa, Artificial Sequence
  Description of Artificial Sequence: Synthetic polypeptide
DDMEISTTNPVAYEGYGQCVCSNWGPDHNTENFFSDTQS

SEQ ID NO: 210610 - protein, 38 aa, Artificial Sequence
  Description of Artificial Sequence: Synthetic polypeptide
DDNEISTTNPVAYEGYGCAVCSNWEEHNAENFISETQS

SEQ ID NO: 210611 - protein, 40 aa, Artificial Sequence
  Description of Artificial Sequence: Synthetic polypeptide
VEDEIATTNPVAYEPPWGSVFAANTGAHQPNHSMGDNTNN

SEQ ID NO: 210612 - protein, 40 aa, Artificial Sequence
  Description of Artificial Sequence: Synthetic polypeptide
DDNEISTTNPVATEGYGQCAVCSTWEEDHNAENFISEFQS

SEQ ID NO: 210613 - protein, 39 aa, Artificial Sequence
  Description of Artificial Sequence: Synthetic polypeptide
DDMEISTTNPVAYEQWGQCVCSNWGEDHNAEGFNSDNQM

SEQ ID NO: 210614 - protein, 39 aa, Artificial Sequence
  Description of Artificial Sequence: Synthetic polypeptide
DDNEISTTNPVATEGYGQCVCQNWGEDPNAENFNSDNQS

SEQ ID NO: 210615 - protein, 39 aa, Artificial Sequence
  Description of Artificial Sequence: Synthetic polypeptide
DSEEISTTNPVGTEQWGQCVCSNWGEDHNAENFISVTQS

SEQ ID NO: 210616 - protein, 39 aa, Artificial Sequence
  Description of Artificial Sequence: Synthetic polypeptide
AEECISTTNPVAYEGYGQCVCSNSGEDHNAENSNSDTQA

SEQ ID NO: 210617 - protein, 39 aa, Artificial Sequence
  Description of Artificial Sequence: Synthetic polypeptide
AEECISCTNPVAYEGYGICVCSNWGEDHNTENFNSDNQA

SEQ ID NO: 210618 - protein, 38 aa, Artificial Sequence
  Description of Artificial Sequence: Synthetic polypeptide
VEDEIATTNPVAYEPQWGTFACAATAGELPDSASNGLM

SEQ ID NO: 210619 - protein, 39 aa, Artificial Sequence
  Description of Artificial Sequence: Synthetic polypeptide
DSSDSCNYNAACTNPVAYEQYGSVCSMAALQMHQGDITA

SEQ ID NO: 210620 - protein, 40 aa, Artificial Sequence
  Description of Artificial Sequence: Synthetic polypeptide
DDEEISTTNPVAYEQYGQCQVCQNWGEDHNIENFNSQNAG

SEQ ID NO: 210621 - protein, 39 aa, Artificial Sequence
  Description of Artificial Sequence: Synthetic polypeptide
DDMEISTTNPVAYEGYGQCVCSNWMEDHNAENFNSDTQG

SEQ ID NO: 210622 - protein, 38 aa, Artificial Sequence
  Description of Artificial Sequence: Synthetic polypeptide
VEDEIATTNPVAYEPPWGSFVANANEANTGGEPMGSLS

SEQ ID NO: 210623 - protein, 38 aa, Artificial Sequence
  Description of Artificial Sequence: Synthetic polypeptide
DEAEIACTNPVATEQWGCIWNAAMQWEEADPSMSENGN

SEQ ID NO: 210624 - protein, 40 aa, Artificial Sequence
  Description of Artificial Sequence: Synthetic polypeptide
VEDEIATTNPVAYEPWGHPFVSAIADGALAQTRHGDSMDG

SEQ ID NO: 210625 - protein, 39 aa, Artificial Sequence
  Description of Artificial Sequence: Synthetic polypeptide
AEECISTTNPVAYEGYGQCVCGNWGEDDNAENFNSDTQI

SEQ ID NO: 210626 - protein, 39 aa, Artificial Sequence
  Description of Artificial Sequence: Synthetic polypeptide
SEAAISTTNPVATEGYGQCVCSNWEEDHNAENFISDFQS

SEQ ID NO: 210627 - protein, 38 aa, Artificial Sequence
  Description of Artificial Sequence: Synthetic polypeptide
SDACISTTNPVAYEGYGCVCSNWGEDPNIENFNSETQN

SEQ ID NO: 210628 - protein, 40 aa, Artificial Sequence
  Description of Artificial Sequence: Synthetic polypeptide
AEECISTTNPVAYEEYGQCQVCSNSGEADNAENFNSDTQN

SEQ ID NO: 210629 - protein, 40 aa, Artificial Sequence
  Description of Artificial Sequence: Synthetic polypeptide
DEACIGTTNPVAYEEYGQCQSCSNWGEDHNTEHSNSDTQS

SEQ ID NO: 210630 - protein, 38 aa, Artificial Sequence
  Description of Artificial Sequence: Synthetic polypeptide
DEDEIATTNPVAYEPWVRPPPAGQGPALITHQDGMEAV

SEQ ID NO: 210631 - protein, 39 aa, Artificial Sequence
  Description of Artificial Sequence: Synthetic polypeptide
CEEEIATTNPVAYAPIWGHVVVAGNSGEPTQGVQDNHSM

SEQ ID NO: 210632 - protein, 39 aa, Artificial Sequence
  Description of Artificial Sequence: Synthetic polypeptide
CEEEIATTNPVAYAPIWGHVFSAGNSGEPTQGVQDEHSM

SEQ ID NO: 210633 - protein, 37 aa, Artificial Sequence
  Description of Artificial Sequence: Synthetic polypeptide
SAQQIATTNPVAYEQWGCICAMTAGIGIATGGDNGTP

SEQ ID NO: 210634 - protein, 39 aa, Artificial Sequence
  Description of Artificial Sequence: Synthetic polypeptide
SEAAIGCTNPVAYEGYGQCVCSNWGEDHNTENFNSDNAS

SEQ ID NO: 210635 - protein, 37 aa, Artificial Sequence
  Description of Artificial Sequence: Synthetic polypeptide
STTAQFASTNPVAYEQWGSVCAAAVALKGEPTIGNEE

SEQ ID NO: 210636 - protein, 39 aa, Artificial Sequence
  Description of Artificial Sequence: Synthetic polypeptide
DENCIRTTNPVAYEGWGQCVCSNSGEDENAENSSSDTAA

SEQ ID NO: 210637 - protein, 39 aa, Artificial Sequence
  Description of Artificial Sequence: Synthetic polypeptide
DETEIRTTNPIATECWGWTTPANAGDAWSSEPTGTPYQF

SEQ ID NO: 210638 - protein, 38 aa, Artificial Sequence
  Description of Artificial Sequence: Synthetic polypeptide
DEDEIATTNPVAYEPWGRPPPPAGQGPADQHQDGMEAV

SEQ ID NO: 210639 - protein, 39 aa, Artificial Sequence
  Description of Artificial Sequence: Synthetic polypeptide
SEYEISCTNPVAYEQYGQCVCENWGEDHNAEHFGSDTQS

SEQ ID NO: 210640 - protein, 38 aa, Artificial Sequence
  Description of Artificial Sequence: Synthetic polypeptide
ADAEISCTNPVAYEGYGCVCSNWGEDHNAEGSNSDNQS

SEQ ID NO: 210641 - protein, 39 aa, Artificial Sequence
  Description of Artificial Sequence: Synthetic polypeptide
DETEIRTTNPIATECWGQTTPANAGDAWSSEPTGTPYIM

SEQ ID NO: 210642 - protein, 39 aa, Artificial Sequence
  Description of Artificial Sequence: Synthetic polypeptide
AEECISTTNPVAYEGYGQCVCFNWMEDHNAENFISETQA

SEQ ID NO: 210643 - protein, 39 aa, Artificial Sequence
  Description of Artificial Sequence: Synthetic polypeptide
SDAAIGCTNPVAYEQYGICVCSNWGEDHNTENFNSDNAS

SEQ ID NO: 210644 - protein, 38 aa, Artificial Sequence
  Description of Artificial Sequence: Synthetic polypeptide
SDAAIGCTNPVAYEGYGCVCSTWGEDHNTENFISDNAS

SEQ ID NO: 210645 - protein, 43 aa, Artificial Sequence
  Description of Artificial Sequence: Synthetic polypeptide
DEDEAEIATTTTVYEAWAYEQWGAVASGESHKNMVDQGGGNER

SEQ ID NO: 210646 - protein, 39 aa, Artificial Sequence
  Description of Artificial Sequence: Synthetic polypeptide
SEAAISTTNPVATCQYGQCVCFNWGEDHNTENFNSDTQS

SEQ ID NO: 210647 - protein, 39 aa, Artificial Sequence
  Description of Artificial Sequence: Synthetic polypeptide
DENCISTTNPVAYEGWGQCVCSNWGEDDNAENFNSDTQQ

SEQ ID NO: 210648 - protein, 39 aa, Artificial Sequence
  Description of Artificial Sequence: Synthetic polypeptide
SDACISCTNPVATEGYGICVCSNWGEDDNTENFNSDNQA

SEQ ID NO: 210649 - protein, 39 aa, Artificial Sequence
  Description of Artificial Sequence: Synthetic polypeptide
SEAAIGTTNPVAYEAYGQCVCQNWGEDHNTENFISDNAS

SEQ ID NO: 210650 - protein, 39 aa, Artificial Sequence
  Description of Artificial Sequence: Synthetic polypeptide
DETEIRTTNPIATECWGKTTPASEGDAWSSEPTGTPYIF

SEQ ID NO: 210651 - protein, 39 aa, Artificial Sequence
  Description of Artificial Sequence: Synthetic polypeptide
SEAAIGCTNPVAYEQYGQCVCSNWGEDHNAENFISDNAS

SEQ ID NO: 210652 - protein, 39 aa, Artificial Sequence
  Description of Artificial Sequence: Synthetic polypeptide
DETEIRTTNPIATECWGKTTPANAGDAISSEPTGTPYIF

SEQ ID NO: 210653 - protein, 39 aa, Artificial Sequence
  Description of Artificial Sequence: Synthetic polypeptide
AEAAISTTNPVAYEGYGQCVCSTWGEDHNAEGFISDTQN

SEQ ID NO: 210654 - protein, 40 aa, Artificial Sequence
  Description of Artificial Sequence: Synthetic polypeptide
CEEEISTTNPVAYEEWGQCICCSMSGEDDNAENFNSDTQS

SEQ ID NO: 210655 - protein, 40 aa, Artificial Sequence
  Description of Artificial Sequence: Synthetic polypeptide
ADMCIRTTNPVAYEQYGQCIVCSNWGYDHNAENFNSETQA

SEQ ID NO: 210656 - protein, 38 aa, Artificial Sequence
  Description of Artificial Sequence: Synthetic polypeptide
AEAAISTTNPVATCGYGQCVCFNWGEHNTENFNSDTQS

SEQ ID NO: 210657 - protein, 39 aa, Artificial Sequence
  Description of Artificial Sequence: Synthetic polypeptide
AEAAISTTNPVAYEGYGQCVCSNWGEAHNAEGFNSDTQN

SEQ ID NO: 210658 - protein, 39 aa, Artificial Sequence
  Description of Artificial Sequence: Synthetic polypeptide
ADAEISTTNPCAYEQYGQCVCQNWGALHNAEHFNSDPQA

SEQ ID NO: 210659 - protein, 39 aa, Artificial Sequence
  Description of Artificial Sequence: Synthetic polypeptide
AEECISTTNPVAYEGYGQCVCGNWGYDHNAEYFNSDTQS

SEQ ID NO: 210660 - protein, 39 aa, Artificial Sequence
  Description of Artificial Sequence: Synthetic polypeptide
SDACISTTNPVATEQYGQCVCSNWGEDHNAENFISDTQP

SEQ ID NO: 210661 - protein, 39 aa, Artificial Sequence
  Description of Artificial Sequence: Synthetic polypeptide
ADAAIGTTNPVAYEGYGICVCSNWGEDHNTENFNSDNAS

SEQ ID NO: 210662 - protein, 39 aa, Artificial Sequence
  Description of Artificial Sequence: Synthetic polypeptide
SDMEISCTNPVATEQWGQCVCFNWGEDTNIEYFNSDTQS

SEQ ID NO: 210663 - protein, 39 aa, Artificial Sequence
  Description of Artificial Sequence: Synthetic polypeptide
AEAAIGTTNPVAYEGYGQCVCSNWGEDHNAENFNSDNAS

SEQ ID NO: 210664 - protein, 39 aa, Artificial Sequence
  Description of Artificial Sequence: Synthetic polypeptide
SETAENIACTNPVAYEQWGANCSATLALPTNHGGDIQAM

SEQ ID NO: 210665 - protein, 39 aa, Artificial Sequence
  Description of Artificial Sequence: Synthetic polypeptide
ADAEISTTNPVATEGYGQCVCSNSGEDHNAESFISDTQG

SEQ ID NO: 210666 - protein, 40 aa, Artificial Sequence
  Description of Artificial Sequence: Synthetic polypeptide
DENCISCTNPVATEGYGQCQVCSNWEEDHNAEYFISENQS

SEQ ID NO: 210667 - protein, 39 aa, Artificial Sequence
  Description of Artificial Sequence: Synthetic polypeptide
DEDEIATTNPVAYEPWGRPPPAAGQGPALQEHQDGMEAV

SEQ ID NO: 210668 - protein, 38 aa, Artificial Sequence
  Description of Artificial Sequence: Synthetic polypeptide
ADACISTTNPVATEGYGCVCSNWGEDHNAENFISDTQP

SEQ ID NO: 210669 - protein, 39 aa, Artificial Sequence
  Description of Artificial Sequence: Synthetic polypeptide
ADACISTTNPVAYEQYGQCVCSMWMEDDNAENFNSDTQS

SEQ ID NO: 210670 - protein, 39 aa, Artificial Sequence
  Description of Artificial Sequence: Synthetic polypeptide
SENEISCTNPVAYEGYGQCVCSNSGEAHNAENFISDNQA

SEQ ID NO: 210671 - protein, 38 aa, Artificial Sequence
  Description of Artificial Sequence: Synthetic polypeptide
ADACISTTNPVATEGYGCVCSMWEEDHNAENFISDTQA

SEQ ID NO: 210672 - protein, 38 aa, Artificial Sequence
  Description of Artificial Sequence: Synthetic polypeptide
SDNEIATTNPVAYEGYGCVCSNWGEDDNQEHFSSETQA

SEQ ID NO: 210673 - protein, 39 aa, Artificial Sequence
  Description of Artificial Sequence: Synthetic polypeptide
SENEISTTNPCAYEGYGQCVCSNWMEDDNAENFNSDPQS

SEQ ID NO: 210674 - protein, 39 aa, Artificial Sequence
  Description of Artificial Sequence: Synthetic polypeptide
SENEISTTNPVATEGWGQCVCSNSGEDENAEYSISDTAS

SEQ ID NO: 210675 - protein, 39 aa, Artificial Sequence
  Description of Artificial Sequence: Synthetic polypeptide
DEMAISTVNPVAYEGYGQCVCSNWGEDDNTENFNSDTQA

SEQ ID NO: 210676 - protein, 39 aa, Artificial Sequence
  Description of Artificial Sequence: Synthetic polypeptide
SDEEISCTNPVAYEGYGQCVCQNWGEGHNDENFISDTAN

SEQ ID NO: 210677 - protein, 39 aa, Artificial Sequence
  Description of Artificial Sequence: Synthetic polypeptide
SDEEISCTNPVAYEGYGICVCGNWGEDDNTENFSSDNQA

SEQ ID NO: 210678 - protein, 38 aa, Artificial Sequence
  Description of Artificial Sequence: Synthetic polypeptide
ADACISTTNPVAYEQYGQCVCSNWGEDNAEGFISETQS

SEQ ID NO: 210679 - protein, 41 aa, Artificial Sequence
  Description of Artificial Sequence: Synthetic polypeptide
DEEEIRTTNPVGYYEPQWGHSICAVTDAAEGTAHPGDLMAM

SEQ ID NO: 210680 - protein, 39 aa, Artificial Sequence
  Description of Artificial Sequence: Synthetic polypeptide
ADACISTVNPVATEQYGQCVCSNWGEDHNAENFNSDTQS

SEQ ID NO: 210681 - protein, 40 aa, Artificial Sequence
  Description of Artificial Sequence: Synthetic polypeptide
SDECISTTNPVAYEQYGQCIVCSNWGYDHNAEYFNSETQL

SEQ ID NO: 210682 - protein, 36 aa, Artificial Sequence
  Description of Artificial Sequence: Synthetic polypeptide
QEHCIATTNPVAYESYGEHAPWCEHEFSMHAEGEWQ

SEQ ID NO: 210683 - protein, 39 aa, Artificial Sequence
  Description of Artificial Sequence: Synthetic polypeptide
SENEISTTNPVAYCYYGQCVCSNSGEDPNAENFNSQTQS

SEQ ID NO: 210684 - protein, 39 aa, Artificial Sequence
  Description of Artificial Sequence: Synthetic polypeptide
SDNCISTTNPVATEGYGQCVCSNWGEDPNAEYFNSDNQA

SEQ ID NO: 210685 - protein, 39 aa, Artificial Sequence
  Description of Artificial Sequence: Synthetic polypeptide
SDNCISTTNPVATCQYGQCVCSNSGEDPNAENFNSQTQL

SEQ ID NO: 210686 - protein, 39 aa, Artificial Sequence
  Description of Artificial Sequence: Synthetic polypeptide
SDMEISCTNPVAYEGYGICVCSNWGEDDNTENFISDNQA

SEQ ID NO: 210687 - protein, 39 aa, Artificial Sequence
  Description of Artificial Sequence: Synthetic polypeptide
SDMEISCTNPVATEAYGQCVCSNWGEDHNAEGFNSDTQS

SEQ ID NO: 210688 - protein, 39 aa, Artificial Sequence
  Description of Artificial Sequence: Synthetic polypeptide
DEAEISCTNPVAYCQYGQCVCSNWGEDHNAENFISDTQS

SEQ ID NO: 210689 - protein, 39 aa, Artificial Sequence
  Description of Artificial Sequence: Synthetic polypeptide
SDMEISCTNPVAYEGYGQCSCSTWEALHNAEHFNSDNQS

SEQ ID NO: 210690 - protein, 39 aa, Artificial Sequence
  Description of Artificial Sequence: Synthetic polypeptide
DENCISCTNPVAYEGYGQCVCSNSGEDDNAEYFNSDNQS

SEQ ID NO: 210691 - protein, 39 aa, Artificial Sequence
  Description of Artificial Sequence: Synthetic polypeptide
SDMCISTTNPVAYEQYGCIVCSNWGEDHNAESFNSETQA

SEQ ID NO: 210692 - protein, 39 aa, Artificial Sequence
  Description of Artificial Sequence: Synthetic polypeptide
ADACISTTNPVATEGYGQCVCSNWEADHNAEFFTSDNQS

SEQ ID NO: 210693 - protein, 39 aa, Artificial Sequence
  Description of Artificial Sequence: Synthetic polypeptide
SDMCISTTNPVAYEGYGQCVCSTWGEWPNAEHFNSETQS

SEQ ID NO: 210694 - protein, 40 aa, Artificial Sequence
  Description of Artificial Sequence: Synthetic polypeptide
DEAEISCTNPVAYCQYGQCQVCGNSGEEHNAEGFNSDTQA

SEQ ID NO: 210695 - protein, 39 aa, Artificial Sequence
  Description of Artificial Sequence: Synthetic polypeptide
DEAEISCTNPVAYEGYGQCVCGMWGEDPNAEGFNSDNQS

SEQ ID NO: 210696 - protein, 39 aa, Artificial Sequence
  Description of Artificial Sequence: Synthetic polypeptide
DENCISTTNPCAYEGYGQCVCSNWGEDHNAEYFNSDPQS

SEQ ID NO: 210697 - protein, 40 aa, Artificial Sequence
  Description of Artificial Sequence: Synthetic polypeptide
ADACISTTNPVATEQYGQCIVCSNWGYDHNAESFISENQL

SEQ ID NO: 210698 - protein, 39 aa, Artificial Sequence
  Description of Artificial Sequence: Synthetic polypeptide
ADRAISTTNPVAYEEYGQCVCSNWNEGTNAENFNSETQS

SEQ ID NO: 210699 - protein, 39 aa, Artificial Sequence
  Description of Artificial Sequence: Synthetic polypeptide
ADACISTTNPVATEQYGQCVCSNWGEDHNAEGFSSETQS

SEQ ID NO: 210700 - protein, 39 aa, Artificial Sequence
  Description of Artificial Sequence: Synthetic polypeptide
DEDEIATTNPVAYEPWGRPPPAGQGPALMQAHQDGMEAV

SEQ ID NO: 210701 - protein, 39 aa, Artificial Sequence
  Description of Artificial Sequence: Synthetic polypeptide
DEAEISCTNPVATEGWGQCVCQNWGEDHNAENFISDTQQ

SEQ ID NO: 210702 - protein, 39 aa, Artificial Sequence
  Description of Artificial Sequence: Synthetic polypeptide
DEAEISCTNPVATEGWGQCVCFNWGEDHNIENFISDNQS

SEQ ID NO: 210703 - protein, 40 aa, Artificial Sequence
  Description of Artificial Sequence: Synthetic polypeptide
DENCISTTNPVATEGYGQCAVCSNWEEDHNAENFISEFQS

SEQ ID NO: 210704 - protein, 40 aa, Artificial Sequence
  Description of Artificial Sequence: Synthetic polypeptide
SDNEISTTNPVATEQYGQCQVCSNSGEAHNAENFISDTQS

SEQ ID NO: 210705 - protein, 39 aa, Artificial Sequence
  Description of Artificial Sequence: Synthetic polypeptide
SDNEISTTNPVAYEGYGQCVCSNSGEDHNAENFISDNQA

SEQ ID NO: 210706 - protein, 39 aa, Artificial Sequence
  Description of Artificial Sequence: Synthetic polypeptide
SENEISTTNPVAYEGWGQCVCSNWGEDHNAENFNSDTQQ

SEQ ID NO: 210707 - protein, 39 aa, Artificial Sequence
  Description of Artificial Sequence: Synthetic polypeptide
AEECISTTNPVAYEGYGCQVCPNWGEDHNAENFISQFQS

SEQ ID NO: 210708 - protein, 39 aa, Artificial Sequence
  Description of Artificial Sequence: Synthetic polypeptide
ADNCISTTNPVATCQYGQCVCSNWGEDDNAEGFNSDNQA

SEQ ID NO: 210709 - protein, 38 aa, Artificial Sequence
  Description of Artificial Sequence: Synthetic polypeptide
DDAAISTVNPVAYEGYGQCVCSNWMEDNTENFNSDPQS

SEQ ID NO: 210710 - protein, 39 aa, Artificial Sequence
  Description of Artificial Sequence: Synthetic polypeptide
ADMEISTTNPVAYEQYGQCYCGNSGEDENAENFISDNQN

SEQ ID NO: 210711 - protein, 39 aa, Artificial Sequence
  Description of Artificial Sequence: Synthetic polypeptide
ADMEISTTNPVAYEQYGQCVCVNWGYDHNAENFNSDTQL

SEQ ID NO: 210712 - protein, 39 aa, Artificial Sequence
  Description of Artificial Sequence: Synthetic polypeptide
ADMEISTTNPVAYEQYGQCVCSNWGEDHNAENFISDTQG

SEQ ID NO: 210713 - protein, 38 aa, Artificial Sequence
  Description of Artificial Sequence: Synthetic polypeptide
SESEIACTNPVGTEGYGICSCGNSGEDNAEHFSSDTQS

SEQ ID NO: 210714 - protein, 40 aa, Artificial Sequence
  Description of Artificial Sequence: Synthetic polypeptide
DDACIATTNPVATEGYGQCQVCSNWGEDHNAEGFNSDTQS

SEQ ID NO: 210715 - protein, 38 aa, Artificial Sequence
  Description of Artificial Sequence: Synthetic polypeptide
SDAEISTTNPVAYEGYGQCVCGWGEDPNAEGFNSDNQS

SEQ ID NO: 210716 - protein, 39 aa, Artificial Sequence
  Description of Artificial Sequence: Synthetic polypeptide
DAAEIATTNPVAYEPVWDGTAFACAGMPAGNPQGGEQRP

SEQ ID NO: 210717 - protein, 39 aa, Artificial Sequence
  Description of Artificial Sequence: Synthetic polypeptide
ADMEISTTNPVAYEQYGQCICSNWGEDDNAENFSSENQL

SEQ ID NO: 210718 - protein, 39 aa, Artificial Sequence
  Description of Artificial Sequence: Synthetic polypeptide
ADMEISTTNPVAYEEYGQCVCSNWNEGDNAENFNSETQS

SEQ ID NO: 210719 - protein, 39 aa, Artificial Sequence
  Description of Artificial Sequence: Synthetic polypeptide
ADMEISTTNPVATEGWGQCVCSMWGEDHNAEFFNSQTQS

SEQ ID NO: 210720 - protein, 39 aa, Artificial Sequence
  Description of Artificial Sequence: Synthetic polypeptide
ADMEISTTNPCAYEQYGQCVCQNWGALHNAENFNSDPQS

SEQ ID NO: 210721 - protein, 39 aa, Artificial Sequence
  Description of Artificial Sequence: Synthetic polypeptide
AEECISTTNPVAYEGWGQCVCSTWGEDPNAENFISETQA

SEQ ID NO: 210722 - protein, 39 aa, Artificial Sequence
  Description of Artificial Sequence: Synthetic polypeptide
DDACIATTNPVAYEGYGQCVCSNWGEDPNAENFNSETQN

SEQ ID NO: 210723 - protein, 39 aa, Artificial Sequence
  Description of Artificial Sequence: Synthetic polypeptide
ADMEISTTNPCAYEQYGQCQVCSNWGEHNAEFFNSDNAA

SEQ ID NO: 210724 - protein, 39 aa, Artificial Sequence
  Description of Artificial Sequence: Synthetic polypeptide
SERCISTTNPVAYEGYGQCVCSNWMEDDNAENFNSDFQP

SEQ ID NO: 210725 - protein, 39 aa, Artificial Sequence
  Description of Artificial Sequence: Synthetic polypeptide
SERCISTTNPVAYEEYGQCVCSNWGEDHNTENFSSDTQA

SEQ ID NO: 210726 - protein, 39 aa, Artificial Sequence
  Description of Artificial Sequence: Synthetic polypeptide
AEAAIGTTNPVAYEGYGQCVCQTWGEDHNTENFNSDNAS

SEQ ID NO: 210727 - protein, 39 aa, Artificial Sequence
  Description of Artificial Sequence: Synthetic polypeptide
NETEIATTNPIATECWGATYYANENDHQLHDKTGQKGMS

SEQ ID NO: 210728 - protein, 39 aa, Artificial Sequence
  Description of Artificial Sequence: Synthetic polypeptide
SDNEISTTNPVAYEGYGQCVCSNWGEPDNTENFISDTQS

SEQ ID NO: 210729 - protein, 39 aa, Artificial Sequence
  Description of Artificial Sequence: Synthetic polypeptide
SDECISTTNPVAYEGYGQCSCSNWEALHNAENFNSDNQS

SEQ ID NO: 210730 - protein, 39 aa, Artificial Sequence
  Description of Artificial Sequence: Synthetic polypeptide
SENEISTTNPVAYEGYGCAVCSNWEEDHNAENFISETQS

SEQ ID NO: 210731 - protein, 39 aa, Artificial Sequence
  Description of Artificial Sequence: Synthetic polypeptide
SDREISCTNPVAYEEYGQCVCSNWGEGTNAENFNSETQA

SEQ ID NO: 210732 - protein, 40 aa, Artificial Sequence
  Description of Artificial Sequence: Synthetic polypeptide
SENEISTTNPVAYEGYGQCIVCSNWEEDHNAENFGSEFQS

SEQ ID NO: 210733 - protein, 39 aa, Artificial Sequence
  Description of Artificial Sequence: Synthetic polypeptide
ADAEIGTTNPVAYEEYGCQSCSNWGEDHNTEHSNSDTQS

SEQ ID NO: 210734 - protein, 38 aa, Artificial Sequence
  Description of Artificial Sequence: Synthetic polypeptide
DEDEIATTNPVAYEPWGRPPPAGQGPAQPQHQDGMEAV

SEQ ID NO: 210735 - protein, 40 aa, Artificial Sequence
  Description of Artificial Sequence: Synthetic polypeptide
SENEISTTNPVAYEGYGQCQVCSDWGEDHNTESFISDNQA

SEQ ID NO: 210736 - protein, 40 aa, Artificial Sequence
  Description of Artificial Sequence: Synthetic polypeptide
AEECISTTNPVAYEQYGQCAVCSNWMEDHNAENFPSETQS

SEQ ID NO: 210737 - protein, 39 aa, Artificial Sequence
  Description of Artificial Sequence: Synthetic polypeptide
SDECISTTNPVATEGYGQCVCPNWGEDHNAENFQSDTQI

SEQ ID NO: 210738 - protein, 39 aa, Artificial Sequence
  Description of Artificial Sequence: Synthetic polypeptide
ADACIRTTNPVAYEQYGQCVCGNWGEDDNAENFNSDTQI

SEQ ID NO: 210739 - protein, 39 aa, Artificial Sequence
  Description of Artificial Sequence: Synthetic polypeptide
DDECISTTNPVAYEGYGQCVCSNWGEDHNAENFISDTQN

SEQ ID NO: 210740 - protein, 39 aa, Artificial Sequence
  Description of Artificial Sequence: Synthetic polypeptide
ADACIATTNPVAYEQYGQCVCSNWGEDHNTEHFNSDTQL

SEQ ID NO: 210741 - protein, 39 aa, Artificial Sequence
  Description of Artificial Sequence: Synthetic polypeptide
AEAAIGCTNPVAYEGYGQCVCSNWMEDHNTENFISDNAS

SEQ ID NO: 210742 - protein, 39 aa, Artificial Sequence
  Description of Artificial Sequence: Synthetic polypeptide
SDECISCTNPVAYEGYGICVCSNWEEDDNTENFISDNQA

SEQ ID NO: 210743 - protein, 39 aa, Artificial Sequence
  Description of Artificial Sequence: Synthetic polypeptide
AEAAIGTTNPVATEGYGQCVCGNWGEDHNAENFISDTQA

SEQ ID NO: 210744 - protein, 39 aa, Artificial Sequence
  Description of Artificial Sequence: Synthetic polypeptide
AEAAIGTTNPVAYEAYGQCVCGNWGEDHNTENFNSDNAA

SEQ ID NO: 210745 - protein, 40 aa, Artificial Sequence
  Description of Artificial Sequence: Synthetic polypeptide
DENCISTTNPVAYCQYGQCQVCSNSGEDPNAENFNSQTQL

SEQ ID NO: 210746 - protein, 40 aa, Artificial Sequence
  Description of Artificial Sequence: Synthetic polypeptide
DENCISCTNPVATEGYGQCAVCSNWEEDHNAENFNSETQS

SEQ ID NO: 210747 - protein, 39 aa, Artificial Sequence
  Description of Artificial Sequence: Synthetic polypeptide
ADAEISTTNPVATEGYGQCVCSNWGEAHNAENFISDTQS

SEQ ID NO: 210748 - protein, 39 aa, Artificial Sequence
  Description of Artificial Sequence: Synthetic polypeptide
ADECISTTNPVAYEGYGQCVCSNWEEDHNIENFGSDPQA

SEQ ID NO: 210749 - protein, 39 aa, Artificial Sequence
  Description of Artificial Sequence: Synthetic polypeptide
TDACISTTNPVATEGYGQCVCSNWGEGHNTEHFNSDTQA

SEQ ID NO: 210750 - protein, 40 aa, Artificial Sequence
  Description of Artificial Sequence: Synthetic polypeptide
VEDEIATTNPVAYEPWGHSFPSAIADGALTQTSHGDSMDG

SEQ ID NO: 210751 - protein, 39 aa, Artificial Sequence
  Description of Artificial Sequence: Synthetic polypeptide
DETCIATTNPCATEGWGQCQTCQNWEEDNAENSGSDNQA

SEQ ID NO: 210752 - protein, 39 aa, Artificial Sequence
  Description of Artificial Sequence: Synthetic polypeptide
DENEISTVNPVAYEGYGQCVCSNWGEDHNAENFISDFQA

SEQ ID NO: 210753 - protein, 42 aa, Artificial Sequence
  Description of Artificial Sequence: Synthetic polypeptide
IQEMEMVVEVTNPIVATTEQIYGFSYYSTNLLLHIQVVLIGH

SEQ ID NO: 210754 - protein, 41 aa, Artificial Sequence
  Description of Artificial Sequence: Synthetic polypeptide
LDEFHCYRTTNDPVIALEWWYLYREVTSQTVNLQIHSKQFE

SEQ ID NO: 210755 - protein, 40 aa, Artificial Sequence
  Description of Artificial Sequence: Synthetic polypeptide
TENEISTTNPVAYEGYGQCQVCSNWEEDHNAENFNSETQS

SEQ ID NO: 210756 - protein, 39 aa, Artificial Sequence
  Description of Artificial Sequence: Synthetic polypeptide
TENTQEIATTNPVAYEQWGVYFTTITIDHQQKDSKGDSP

SEQ ID NO: 210757 - protein, 38 aa, Artificial Sequence
  Description of Artificial Sequence: Synthetic polypeptide
CEDEIATTNPVAYEPWGRPPPAGQGPALTVHQDGMEIV

SEQ ID NO: 210758 - protein, 40 aa, Artificial Sequence
  Description of Artificial Sequence: Synthetic polypeptide
MEAEELGVMGTVINPNFTGQTDQHGSAQTMNLQEGQGENE

SEQ ID NO: 210759 - protein, 40 aa, Artificial Sequence
  Description of Artificial Sequence: Synthetic polypeptide
DETCIRTTNPCATEGWGQCQTCQNAEEDDNAENSGSDNQA

SEQ ID NO: 210760 - protein, 39 aa, Artificial Sequence
  Description of Artificial Sequence: Synthetic polypeptide
AEEAISTTNPVAYEGYGQCVCFNWGEDHNAENFISETQS

SEQ ID NO: 210761 - protein, 38 aa, Artificial Sequence
  Description of Artificial Sequence: Synthetic polypeptide
QAEEIATTNPVAYEQWGTAFACAMLNGGEPDIGGGEMW

SEQ ID NO: 210762 - protein, 43 aa, Artificial Sequence
  Description of Artificial Sequence: Synthetic polypeptide
DEMVIIGRGTTNPVFMTECQYIGMPVSSVVNLNEVRQTAEPEE

SEQ ID NO: 210763 - protein, 39 aa, Artificial Sequence
  Description of Artificial Sequence: Synthetic polypeptide
AEEAISTTNPVAYEGYGQCVCSNWGEDHNAENFISDTQN

SEQ ID NO: 210764 - protein, 39 aa, Artificial Sequence
  Description of Artificial Sequence: Synthetic polypeptide
MEECIATTNPVAYEGYGQCVCYNWGEDHNTENFNSETQL

SEQ ID NO: 210765 - protein, 38 aa, Artificial Sequence
  Description of Artificial Sequence: Synthetic polypeptide
NEEEIACTNPVATEQWGCTTIFAGAGMDHGPDDSGEGA

SEQ ID NO: 210766 - protein, 38 aa, Artificial Sequence
  Description of Artificial Sequence: Synthetic polypeptide
DEAEIRTTNPCAYEGWGCQTCQNAEEDNAEHSNSDNQS

SEQ ID NO: 210767 - protein, 39 aa, Artificial Sequence
  Description of Artificial Sequence: Synthetic polypeptide
CEMEISTTNPVAYEQYGQCVCSNWGEDHDIEHFISDTQS

SEQ ID NO: 210768 - protein, 40 aa, Artificial Sequence
  Description of Artificial Sequence: Synthetic polypeptide
DEEEISTTNPCAYEGYGQCAVCETWGEDHNAENFISDTQP

SEQ ID NO: 210769 - protein, 41 aa, Artificial Sequence
  Description of Artificial Sequence: Synthetic polypeptide
DEEEIATTNPVAYAAPIPWGHSHSAGNNGEPTQGVQDNHSM

SEQ ID NO: 210770 - protein, 40 aa, Artificial Sequence
  Description of Artificial Sequence: Synthetic polypeptide
DEAAIGTTNPVAYEGYGQCQVCGNWGEDHNTENFSSDNAS

SEQ ID NO: 210771 - protein, 38 aa, Artificial Sequence
  Description of Artificial Sequence: Synthetic polypeptide
DETCIRTTNPIATECWGETTPANAGDAWSGEPTGTPYI

SEQ ID NO: 210772 - protein, 40 aa, Artificial Sequence
  Description of Artificial Sequence: Synthetic polypeptide
TENCIATTNPVATEGYGQCAVCSNWEEDHNAENFNSEFQS

SEQ ID NO: 210773 - protein, 39 aa, Artificial Sequence
  Description of Artificial Sequence: Synthetic polypeptide
VEDEIATTNPVAYEPWGHSSSAIADGALTATNHGDSSVM

SEQ ID NO: 210774 - protein, 39 aa, Artificial Sequence
  Description of Artificial Sequence: Synthetic polypeptide
CEAAISTTNPVATEGYGQCVCSNWGEDHNAENFISDTQQ

SEQ ID NO: 210775 - protein, 39 aa, Artificial Sequence
  Description of Artificial Sequence: Synthetic polypeptide
AEEAISTTNPVAYCGYGQCVCSTWGEDHNAENFISDPQS

SEQ ID NO: 210776 - protein, 40 aa, Artificial Sequence
  Description of Artificial Sequence: Synthetic polypeptide
AEECISTTNPVATEGYGQCAVCQNWGEPHNAENFGSEFQS

SEQ ID NO: 210777 - protein, 41 aa, Artificial Sequence
  Description of Artificial Sequence: Synthetic polypeptide
TEEENCGATNNNPCATESWGVVATGSQQNAGEENRQGNNER

SEQ ID NO: 210778 - protein, 38 aa, Artificial Sequence
  Description of Artificial Sequence: Synthetic polypeptide
CEDEIATTNPVAYEPWGCPPPAGQGPALGTHQDGMEAV

SEQ ID NO: 210779 - protein, 38 aa, Artificial Sequence
  Description of Artificial Sequence: Synthetic polypeptide
CESVIACTNPVATEQYGCIPPAANEHPEAGGPGDEAAG

SEQ ID NO: 210780 - protein, 41 aa, Artificial Sequence
  Description of Artificial Sequence: Synthetic polypeptide
DENEIATTNPTCQLYYYEPYGSTVAVNSDGGQGGMNPNGQD

SEQ ID NO: 210781 - protein, 38 aa, Artificial Sequence
  Description of Artificial Sequence: Synthetic polypeptide
ADEAISTTNPVAYEGYGCVCGNWGEDHNDEHFNSDTQA

SEQ ID NO: 210782 - protein, 39 aa, Artificial Sequence
  Description of Artificial Sequence: Synthetic polypeptide
DENEISTTNPVAYEGWGICVCSNSGEDENAEYSISDTAS

SEQ ID NO: 210783 - protein, 39 aa, Artificial Sequence
  Description of Artificial Sequence: Synthetic polypeptide
DENAIRTTNPCAYEGYGQCVCGNWGEDHNDENFNSDTQA

SEQ ID NO: 210784 - protein, 39 aa, Artificial Sequence
  Description of Artificial Sequence: Synthetic polypeptide
CDEEISTTNPVAYEGYGQCVCSNWGYDHNAENFFSDTQA

SEQ ID NO: 210785 - protein, 39 aa, Artificial Sequence
  Description of Artificial Sequence: Synthetic polypeptide
DENEISTTNPVAYEGWGICVTSNWGEDENTEYFISDTAS

SEQ ID NO: 210786 - protein, 39 aa, Artificial Sequence
  Description of Artificial Sequence: Synthetic polypeptide
ADEAISTTNPVAYEQYGQCVCSNWGEDHNAEGFSSDTQN

SEQ ID NO: 210787 - protein, 39 aa, Artificial Sequence
  Description of Artificial Sequence: Synthetic polypeptide
AEECISTTNPVATEGWGQCVCQNWGEDHNAENFNSDTQQ

SEQ ID NO: 210788 - protein, 38 aa, Artificial Sequence
  Description of Artificial Sequence: Synthetic polypeptide
HEWTYVDRGTVRPWTTVECYGGNVYVTLDDFQRHGQVR

SEQ ID NO: 210789 - protein, 40 aa, Artificial Sequence
  Description of Artificial Sequence: Synthetic polypeptide
DENEIATTNPVATEQWGCTNNQANMNGVDPATAEIDEEWP

SEQ ID NO: 210790 - protein, 37 aa, Artificial Sequence
  Description of Artificial Sequence: Synthetic polypeptide
CEDEIATTNPVAYEPWGRPPPAGQGPAHTHQDGMEAE

SEQ ID NO: 210791 - protein, 40 aa, Artificial Sequence
  Description of Artificial Sequence: Synthetic polypeptide
DENEISTTNPVAYEGYGQCQVCSNWGEDHNTESFISDTQA

SEQ ID NO: 210792 - protein, 38 aa, Artificial Sequence
  Description of Artificial Sequence: Synthetic polypeptide
VEDEIATTNPVAYEPWGRPPPTAGQGPAEQHQDGMEAW

SEQ ID NO: 210793 - protein, 38 aa, Artificial Sequence
  Description of Artificial Sequence: Synthetic polypeptide
VESEIACTNPVATEQWGCIWNAAMNGEEADPSMSEEGN

SEQ ID NO: 210794 - protein, 39 aa, Artificial Sequence
  Description of Artificial Sequence: Synthetic polypeptide
AEEAISTTNPVAYEGYGQCVCENWGEDDNAEHFNSDTQA

SEQ ID NO: 210795 - protein, 39 aa, Artificial Sequence
  Description of Artificial Sequence: Synthetic polypeptide
VEDEIATTNPVAYAPWGHSFISAIADGALTNTRHGDSDG

SEQ ID NO: 210796 - protein, 39 aa, Artificial Sequence
  Description of Artificial Sequence: Synthetic polypeptide
CEACIGTTNPCAYEQYGQCVCYNWGEDDNQENFNSDTQS

SEQ ID NO: 210797 - protein, 39 aa, Artificial Sequence
  Description of Artificial Sequence: Synthetic polypeptide
DEAAIGCTNPVAYEGYGQCVCGNWMEDHNTENFNSDNAA

SEQ ID NO: 210798 - protein, 37 aa, Artificial Sequence
  Description of Artificial Sequence: Synthetic polypeptide
TETEIRTTNPIAYECWGQATIPACAESWAEPTGPYID

SEQ ID NO: 210799 - protein, 38 aa, Artificial Sequence
  Description of Artificial Sequence: Synthetic polypeptide
ADECISCTNPVAYEEYGQCVCSNSGEHNAEYFNSDNQS

SEQ ID NO: 210800 - protein, 39 aa, Artificial Sequence
  Description of Artificial Sequence: Synthetic polypeptide
ADECISTTNPVATCGYGQCVCSTWGEDHNAENFISDPQS

SEQ ID NO: 210801 - protein, 40 aa, Artificial Sequence
  Description of Artificial Sequence: Synthetic polypeptide
QAEEIATTNPVATEQWGCTNNQANMNGVDTATANIDEEWP

SEQ ID NO: 210802 - protein, 38 aa, Artificial Sequence
  Description of Artificial Sequence: Synthetic polypeptide
DEGEIATTNPVAYEPWGRPPPAGQGPALTDHPDGMEAV

SEQ ID NO: 210803 - protein, 39 aa, Artificial Sequence
  Description of Artificial Sequence: Synthetic polypeptide
CDAEIRTTNPVAYEGYGQCVCGTWGEDHNAENFISDTQA

SEQ ID NO: 210804 - protein, 39 aa, Artificial Sequence
  Description of Artificial Sequence: Synthetic polypeptide
CDAEIRTTNPVAYEEYGQCVCGNWMEDHNAENFISDTQA

SEQ ID NO: 210805 - protein, 39 aa, Artificial Sequence
  Description of Artificial Sequence: Synthetic polypeptide
AQAEISTTNPVAYEEYGQCVCSNSGEDHNAEHFNSDNQF

SEQ ID NO: 210806 - protein, 40 aa, Artificial Sequence
  Description of Artificial Sequence: Synthetic polypeptide
DEQEIATTNPVATEQWGCTNNQANANNVDTATADSDEMWP

SEQ ID NO: 210807 - protein, 40 aa, Artificial Sequence
  Description of Artificial Sequence: Synthetic polypeptide
DEHEIATTNPVAYAPSHWGHSHSAGNSGEPTQGVQDNHSM

SEQ ID NO: 210808 - protein, 38 aa, Artificial Sequence
  Description of Artificial Sequence: Synthetic polypeptide
TSNEVASTNPVSYEPYGNVVAAANATISQMSTGGQNRL

SEQ ID NO: 210809 - protein, 37 aa, Artificial Sequence
  Description of Artificial Sequence: Synthetic polypeptide
VEAEIACTNPVATEQWGCIWNAAMNGEEADPSMMEGP

SEQ ID NO: 210810 - protein, 40 aa, Artificial Sequence
  Description of Artificial Sequence: Synthetic polypeptide
DEHEIATTNPVAYAPQWGHVIIPPAANNMTQMQQNMQSTH

SEQ ID NO: 210811 - protein, 40 aa, Artificial Sequence
  Description of Artificial Sequence: Synthetic polypeptide
DEHEIATTNPVAYAPPWGVTSAGITGEPLGIAHAGDNSDD

SEQ ID NO: 210812 - protein, 38 aa, Artificial Sequence
  Description of Artificial Sequence: Synthetic polypeptide
AEECISCTNPVAYEGYGQCICSNWGEDNAENFNSENQL

SEQ ID NO: 210813 - protein, 39 aa, Artificial Sequence
  Description of Artificial Sequence: Synthetic polypeptide
ADECISTTNPVAYEGYGQCIVCSNWGEHNAESFNSETQL

SEQ ID NO: 210814 - protein, 39 aa, Artificial Sequence
  Description of Artificial Sequence: Synthetic polypeptide
AEECISCTNPVAYEGWGQCVCFNWGEDTNIENFGSDNQS

SEQ ID NO: 210815 - protein, 40 aa, Artificial Sequence
  Description of Artificial Sequence: Synthetic polypeptide
DENEIATTNPVAYAPIPWGHSHSAGNSGEPTQGVQDNHAM

SEQ ID NO: 210816 - protein, 39 aa, Artificial Sequence
  Description of Artificial Sequence: Synthetic polypeptide
DEGEIATTNPVAYYYMPQWGCIATTAAGTGPPDQTEGRA

SEQ ID NO: 210817 - protein, 40 aa, Artificial Sequence
  Description of Artificial Sequence: Synthetic polypeptide
QAEEIATTNPVATEQWGGCFNCAATEPMEGDNNMSQMNDW

SEQ ID NO: 210818 - protein, 39 aa, Artificial Sequence
  Description of Artificial Sequence: Synthetic polypeptide
DENEIATTNPVAYEPQWGHCIFAGAEHGDQAAAAGAGMN

SEQ ID NO: 210819 - protein, 38 aa, Artificial Sequence
  Description of Artificial Sequence: Synthetic polypeptide
CDAEIGTTNPVAYEGYGCVCGNWGEDHNAENFISDTQA

SEQ ID NO: 210820 - protein, 39 aa, Artificial Sequence
  Description of Artificial Sequence: Synthetic polypeptide
ADECISCTNPVATEQWGQCVCFNWGEDTNIEYFNSDTQS

SEQ ID NO: 210821 - protein, 40 aa, Artificial Sequence
  Description of Artificial Sequence: Synthetic polypeptide
ADECIRTTNPVAYEGYGQCIVCSNWGYDHNAESFNSENQL

SEQ ID NO: 210822 - protein, 37 aa, Artificial Sequence
  Description of Artificial Sequence: Synthetic polypeptide
DEQEIATTNPCAYAPWGATTTANATDGPAEPKGSPQN

SEQ ID NO: 210823 - protein, 40 aa, Artificial Sequence
  Description of Artificial Sequence: Synthetic polypeptide
CDEEIRTTNPVAYEQWGQCQTCGNWGADDNIENFNSDTQA

SEQ ID NO: 210824 - protein, 42 aa, Artificial Sequence
  Description of Artificial Sequence: Synthetic polypeptide
CDECLEGNRTLTNPVVAITDCQKYEKEVNVNDLTDSVVMNRI

SEQ ID NO: 210825 - protein, 41 aa, Artificial Sequence
  Description of Artificial Sequence: Synthetic polypeptide
TEVEIHIRSVYNPLSFYEHYGETVSTGNADSQERTVGDNQT

SEQ ID NO: 210826 - protein, 40 aa, Artificial Sequence
  Description of Artificial Sequence: Synthetic polypeptide
DENEIGTTNPVAYEGYGQCQVCSNWEEDHNAENFISEFQS

SEQ ID NO: 210827 - protein, 37 aa, Artificial Sequence
  Description of Artificial Sequence: Synthetic polypeptide
AEECIACVNPVCYEQYGVVCSNWGEHNAESFISDTQA

SEQ ID NO: 210828 - protein, 39 aa, Artificial Sequence
  Description of Artificial Sequence: Synthetic polypeptide
DEDEIRTTNPIATECWGATTPANAGDAWSAEPTGTPYII

SEQ ID NO: 210829 - protein, 40 aa, Artificial Sequence
  Description of Artificial Sequence: Synthetic polypeptide
DEAEIRCTNPVAYEGYGQCQVCSNWEEDHNAENFISEFQS

SEQ ID NO: 210830 - protein, 41 aa, Artificial Sequence
  Description of Artificial Sequence: Synthetic polypeptide
PCHFEEFKRTYFNPVQARTAAQFEAGSVMAHNCQRHWIIFR

SEQ ID NO: 210831 - protein, 40 aa, Artificial Sequence
  Description of Artificial Sequence: Synthetic polypeptide
DEAAIGCTNPVAYEGYGQCQVCSNWGEDHNTENFISDNAS

SEQ ID NO: 210832 - protein, 39 aa, Artificial Sequence
  Description of Artificial Sequence: Synthetic polypeptide
ADECISTTNPVAYEQYGQCVCSDWEPDHNAENFISDFQA

SEQ ID NO: 210833 - protein, 39 aa, Artificial Sequence
  Description of Artificial Sequence: Synthetic polypeptide
DEAAIACTNPVAYEGYGQCVCGNWGEDHNAEGFNSVFQA

SEQ ID NO: 210834 - protein, 39 aa, Artificial Sequence
  Description of Artificial Sequence: Synthetic polypeptide
AEECISTTNPCAYEGYGQCVCSNWGEEHNTENSNSDTQA

SEQ ID NO: 210835 - protein, 39 aa, Artificial Sequence
  Description of Artificial Sequence: Synthetic polypeptide
ADECISTTNPVAYEGYGQCVCSNWMEAHNAENSNSDTQS

SEQ ID NO: 210836 - protein, 38 aa, Artificial Sequence
  Description of Artificial Sequence: Synthetic polypeptide
CEGEIATTNPVAYEQWGHCIIFAGNSGLVDNDSEADAP

SEQ ID NO: 210837 - protein, 39 aa, Artificial Sequence
  Description of Artificial Sequence: Synthetic polypeptide
DEAEIRTTNPCATEGWGCQTCQNWEEDDNAENSISDNQA

SEQ ID NO: 210838 - protein, 39 aa, Artificial Sequence
  Description of Artificial Sequence: Synthetic polypeptide
AEECISTTNPCAYEAYGQCVCQNWGALHNAEYFNSDTQS

SEQ ID NO: 210839 - protein, 38 aa, Artificial Sequence
  Description of Artificial Sequence: Synthetic polypeptide
DEQEIACTNPVAYEQWGHCIIFAGNSGLVDNDSEADAM

SEQ ID NO: 210840 - protein, 40 aa, Artificial Sequence
  Description of Artificial Sequence: Synthetic polypeptide
CDEAIRCTNPVATEGYGQCAVCSNWGEDDNIEHFNSDTQA

SEQ ID NO: 210841 - protein, 39 aa, Artificial Sequence
  Description of Artificial Sequence: Synthetic polypeptide
AETEIRTTNPCATEGWGQCQTCQNWEEDNAENSISDNQA

SEQ ID NO: 210842 - protein, 38 aa, Artificial Sequence
  Description of Artificial Sequence: Synthetic polypeptide
AETEIRTTNPIATEAWGATTPANAGDAWSSEPTGTPYI

SEQ ID NO: 210843 - protein, 37 aa, Artificial Sequence
  Description of Artificial Sequence: Synthetic polypeptide
MEEELGINSDLLIMPQPARTEYAQDQNFPNLDQFGER

SEQ ID NO: 210844 - protein, 40 aa, Artificial Sequence
  Description of Artificial Sequence: Synthetic polypeptide
CDEEISTTNPVATEQWGQCQSCGNWGADNNIENFNSDTQA

SEQ ID NO: 210845 - protein, 37 aa, Artificial Sequence
  Description of Artificial Sequence: Synthetic polypeptide
DETEIATTNPCAYAPWGATTVANATDGPAEPKGTPQN

SEQ ID NO: 210846 - protein, 37 aa, Artificial Sequence
  Description of Artificial Sequence: Synthetic polypeptide
DETEIATTNPCAYAPWGCATTIANATDGPAEPKGPQN

SEQ ID NO: 210847 - protein, 37 aa, Artificial Sequence
  Description of Artificial Sequence: Synthetic polypeptide
DETEIATTNPCAYAPWGHATTSANATDGPAEPKIPQN

SEQ ID NO: 210848 - protein, 39 aa, Artificial Sequence
  Description of Artificial Sequence: Synthetic polypeptide
DETEIRTTNPIATECWGATTPACNGDAWSSEPTGTPYIF

SEQ ID NO: 210849 - protein, 40 aa, Artificial Sequence
  Description of Artificial Sequence: Synthetic polypeptide
CEAEISTTNPVAYEQYGQCQVCGNWGEDDNAEYFNSDNQA

SEQ ID NO: 210850 - protein, 39 aa, Artificial Sequence
  Description of Artificial Sequence: Synthetic polypeptide
AEEEISCTNPVAYEGYGQCVCSNWGEDHNAEGFISDPQS

SEQ ID NO: 210851 - protein, 40 aa, Artificial Sequence
  Description of Artificial Sequence: Synthetic polypeptide
AEEEISCTNPVAYEGYGQCAVCSNWGEDHNAENFGSDTQA

SEQ ID NO: 210852 - protein, 39 aa, Artificial Sequence
  Description of Artificial Sequence: Synthetic polypeptide
AEEEISCTNPVAYEGWGQCVCFNWGEDTNIEYFNSDTQS

SEQ ID NO: 210853 - protein, 40 aa, Artificial Sequence
  Description of Artificial Sequence: Synthetic polypeptide
CEAEISTTNPVAYEQWGQCISCSMSGEDHNAENFNSDTQS

SEQ ID NO: 210854 - protein, 40 aa, Artificial Sequence
  Description of Artificial Sequence: Synthetic polypeptide
CEAEISTTNPVAYEGYGQCQVCSNWGEPHNTENFGSDTQA

SEQ ID NO: 210855 - protein, 40 aa, Artificial Sequence
  Description of Artificial Sequence: Synthetic polypeptide
DEMAIGTTNPCATEGWGQCQVCSNWMEDTNIENFNSDTQA

SEQ ID NO: 210856 - protein, 40 aa, Artificial Sequence
  Description of Artificial Sequence: Synthetic polypeptide
DETEIRCTNPCATEGWGICQTCQNWEEDDNAENSGSDNQA

SEQ ID NO: 210857 - protein, 38 aa, Artificial Sequence
  Description of Artificial Sequence: Synthetic polypeptide
DETEIRTTNPIATECWGATTPANAGDADSSEPTSTPYI

SEQ ID NO: 210858 - protein, 37 aa, Artificial Sequence
  Description of Artificial Sequence: Synthetic polypeptide
DETEIQTTNPIAYECWGETTVACAEDEWSAEPKVPYP

SEQ ID NO: 210859 - protein, 38 aa, Artificial Sequence
  Description of Artificial Sequence: Synthetic polypeptide
AESEIACTNPVGTEGYGQCSCGNSGEHNAEHFISDTQS

SEQ ID NO: 210860 - protein, 38 aa, Artificial Sequence
  Description of Artificial Sequence: Synthetic polypeptide
AESEIACTNPVGYEGYGVSCGNSGEDHNAEHFGSDTQS

SEQ ID NO: 210861 - protein, 38 aa, Artificial Sequence
  Description of Artificial Sequence: Synthetic polypeptide
DEMEIRTTNPCAYEGWGCQTCQNWEEDNAENSNSDNQA

SEQ ID NO: 210862 - protein, 39 aa, Artificial Sequence
  Description of Artificial Sequence: Synthetic polypeptide
DERCISTTNPCAYEYYGQCVCSNWGYDHNTEGFNSDNQA

SEQ ID NO: 210863 - protein, 39 aa, Artificial Sequence
  Description of Artificial Sequence: Synthetic polypeptide
DEECISTTNPVAYEEWGQCVCSDWEEDHNIENFISDTQS

SEQ ID NO: 210864 - protein, 39 aa, Artificial Sequence
  Description of Artificial Sequence: Synthetic polypeptide
AEECISCTNPVATEGYGQCVCFNWGEDHNAENFISETQS

SEQ ID NO: 210865 - protein, 39 aa, Artificial Sequence
  Description of Artificial Sequence: Synthetic polypeptide
DENEISCTNPVAYEGYGQCQVCSNWEEHNAENFISETQS

SEQ ID NO: 210866 - protein, 37 aa, Artificial Sequence
  Description of Artificial Sequence: Synthetic polypeptide
NEMVIGTTNPVATEQWGQCLCQAWDGSPVEFETMDKP

SEQ ID NO: 210867 - protein, 39 aa, Artificial Sequence
  Description of Artificial Sequence: Synthetic polypeptide
DEECISTTNPVAYEGWGQCCCSNWGEDHNTENFNSDTQA

SEQ ID NO: 210868 - protein, 40 aa, Artificial Sequence
  Description of Artificial Sequence: Synthetic polypeptide
AEEEISCTNPCATEGYGQCQVCSNWGEDHNAEFFNSDTQS

SEQ ID NO: 210869 - protein, 39 aa, Artificial Sequence
  Description of Artificial Sequence: Synthetic polypeptide
DETEIRTTNPIATECWGATTPANAGDAWSGEPTGTPYIV

SEQ ID NO: 210870 - protein, 40 aa, Artificial Sequence
  Description of Artificial Sequence: Synthetic polypeptide
AEEEISTTNPCATEGWGQCQVCSNWGEDHNAEFFNSDTAS

SEQ ID NO: 210871 - protein, 40 aa, Artificial Sequence
  Description of Artificial Sequence: Synthetic polypeptide
AEEEISTTNPCATEGYGQCQVCGNWGEDHNAEFFNSDNAS

SEQ ID NO: 210872 - protein, 40 aa, Artificial Sequence
  Description of Artificial Sequence: Synthetic polypeptide
TDACISTTNPVATEQYGQCQVCSNWGELHNTEHFNSDTQL

SEQ ID NO: 210873 - protein, 39 aa, Artificial Sequence
  Description of Artificial Sequence: Synthetic polypeptide
TDACISTTNPVAYEGYGQCVCSTWGEEDNTEHFNSDTQL

SEQ ID NO: 210874 - protein, 39 aa, Artificial Sequence
  Description of Artificial Sequence: Synthetic polypeptide
TDACISTTNPVAYEQYGQCVCSNWGEDHNTEHFNSDTQS

SEQ ID NO: 210875 - protein, 37 aa, Artificial Sequence
  Description of Artificial Sequence: Synthetic polypeptide
DEDEIATTNPVAYAPWGVTACAATAGEGPDSASNPKN

SEQ ID NO: 210876 - protein, 39 aa, Artificial Sequence
  Description of Artificial Sequence: Synthetic polypeptide
DENCISTVNPVAYEGYGQCVCSNWGEDHNAENFNSVFQA

SEQ ID NO: 210877 - protein, 40 aa, Artificial Sequence
  Description of Artificial Sequence: Synthetic polypeptide
DEAAISTTNPVAYEGYGQCAVCSNWGEDDNAENFNSDNQS

SEQ ID NO: 210878 - protein, 39 aa, Artificial Sequence
  Description of Artificial Sequence: Synthetic polypeptide
TDNCISTTNPVATEGYGQCVCSNWGEDPNAENFNSDNQS

SEQ ID NO: 210879 - protein, 41 aa, Artificial Sequence
  Description of Artificial Sequence: Synthetic polypeptide
QQDEDEIWRYNTNPADPTESHYGGSFGSQLMVWLPRGPTFC

SEQ ID NO: 210880 - protein, 38 aa, Artificial Sequence
  Description of Artificial Sequence: Synthetic polypeptide
DEDEIACTNPVATEQWGCTFIFAGAGMHGPDDSGEGAQ

SEQ ID NO: 210881 - protein, 39 aa, Artificial Sequence
  Description of Artificial Sequence: Synthetic polypeptide
TEAAIGTTNPVAYEGWGQCVCSNWGEDHNTENFSSDNAS

SEQ ID NO: 210882 - protein, 39 aa, Artificial Sequence
  Description of Artificial Sequence: Synthetic polypeptide
DERCISTTNPVAYEGYGQCVCGNWPEDDNAENFNSDTQP

SEQ ID NO: 210883 - protein, 38 aa, Artificial Sequence
  Description of Artificial Sequence: Synthetic polypeptide
DEDEIATTNPVAYAPWGRPPPAGQGPALITHQDGTEAV

SEQ ID NO: 210884 - protein, 38 aa, Artificial Sequence
  Description of Artificial Sequence: Synthetic polypeptide
DDSEVACTNPVSTEGYGCVCGTWGEAHNQEYFGSQTQA

SEQ ID NO: 210885 - protein, 38 aa, Artificial Sequence
  Description of Artificial Sequence: Synthetic polypeptide
DEDEIATTNPVAYAPWGHTACAATAGELPDSTASNPNN

SEQ ID NO: 210886 - protein, 37 aa, Artificial Sequence
  Description of Artificial Sequence: Synthetic polypeptide
DDSEVACTNPVSTEGYGCVCQNWGEPNQEYFMSQTQA

SEQ ID NO: 210887 - protein, 39 aa, Artificial Sequence
  Description of Artificial Sequence: Synthetic polypeptide
DEMAISTTNPEAYEHYGQCVCSNWGEDHNAENFNSETQA

SEQ ID NO: 210888 - protein, 38 aa, Artificial Sequence
  Description of Artificial Sequence: Synthetic polypeptide
DDSEVACTNPVSTEGYGCVCQNWMEDPNQEYFGSQTQA

SEQ ID NO: 210889 - protein, 38 aa, Artificial Sequence
  Description of Artificial Sequence: Synthetic polypeptide
DEAAISTTNPCAYEGYGQCVCPNWEEHNAENFNSDTQF

SEQ ID NO: 210890 - protein, 37 aa, Artificial Sequence
  Description of Artificial Sequence: Synthetic polypeptide
DDSEVASTNPVSTEGYGCVCFNWGEHNQEYFISQTQA

SEQ ID NO: 210891 - protein, 40 aa, Artificial Sequence
  Description of Artificial Sequence: Synthetic polypeptide
AEEEISTTNPCAYEGYGQCQVCSNWGEDHNQEFFNSDNAA

SEQ ID NO: 210892 - protein, 40 aa, Artificial Sequence
  Description of Artificial Sequence: Synthetic polypeptide
AEEEISTTNPCAYEGYGQCQVCSNWGEDHNAENFNSDTAS

SEQ ID NO: 210893 - protein, 39 aa, Artificial Sequence
  Description of Artificial Sequence: Synthetic polypeptide
CEAEISTTNPCAYEQYGQCVCPNWMEDHNAEYFFSDNQS

SEQ ID NO: 210894 - protein, 40 aa, Artificial Sequence
  Description of Artificial Sequence: Synthetic polypeptide
FEETVVRTTNAVAYIEQQGYMGEACWTVTAVEVSTVGVNR

SEQ ID NO: 210895 - protein, 39 aa, Artificial Sequence
  Description of Artificial Sequence: Synthetic polypeptide
FEEVTIWIGTTNPVAHIWETISVILAWTLGYQHTCVQNR

SEQ ID NO: 210896 - protein, 38 aa, Artificial Sequence
  Description of Artificial Sequence: Synthetic polypeptide
DETEIATTNPIAYEVWGATTYANATDGPAEPKGSPQNT

SEQ ID NO: 210897 - protein, 40 aa, Artificial Sequence
  Description of Artificial Sequence: Synthetic polypeptide
ADEEISTTNPCAYEQYGQCQVCSNWGEDHNAEFFNSDNAS

SEQ ID NO: 210898 - protein, 40 aa, Artificial Sequence
  Description of Artificial Sequence: Synthetic polypeptide
CEAEIRTTNPVAYEGWGQCISCSMSGEDDNAENFNSDTQS

SEQ ID NO: 210899 - protein, 39 aa, Artificial Sequence
  Description of Artificial Sequence: Synthetic polypeptide
ADEEISTTNPCAYEGYGQCVCQTWGALDNAENFNSDPQA

SEQ ID NO: 210900 - protein, 38 aa, Artificial Sequence
  Description of Artificial Sequence: Synthetic polypeptide
CEAEICTTNPVAYEPWGCAYNQLRPNDKDERKPDKHGP

SEQ ID NO: 210901 - protein, 38 aa, Artificial Sequence
  Description of Artificial Sequence: Synthetic polypeptide
CEAEIATTNPVAYYAPWGCSTPANANHVDVTQGGPMQK

SEQ ID NO: 210902 - protein, 39 aa, Artificial Sequence
  Description of Artificial Sequence: Synthetic polypeptide
ADEEISCTNPVAYEGYGQCSCSTWGEDHNAEHFMSDTQA

SEQ ID NO: 210903 - protein, 39 aa, Artificial Sequence
  Description of Artificial Sequence: Synthetic polypeptide
DENCIACTNPVATCGYGQCVCGNWGEDDNAEGFNSDTQS

SEQ ID NO: 210904 - protein, 39 aa, Artificial Sequence
  Description of Artificial Sequence: Synthetic polypeptide
CEAEEIATTNPVAYEPWGCAYNQLRPNDKDERKGDKEGM

SEQ ID NO: 210905 - protein, 39 aa, Artificial Sequence
  Description of Artificial Sequence: Synthetic polypeptide
CEACISTTNPVAYEQYGQCVCSNWGEDHNAESFPSDTQM

SEQ ID NO: 210906 - protein, 36 aa, Artificial Sequence
  Description of Artificial Sequence: Synthetic polypeptide
DENEIATTNPCAYAPWGATTAANATDGPAEPKGPQN

SEQ ID NO: 210907 - protein, 39 aa, Artificial Sequence
  Description of Artificial Sequence: Synthetic polypeptide
ADAEISTTNPVAYEGYGQCVCSNWGEDPNAENFGSDTQS

SEQ ID NO: 210908 - protein, 36 aa, Artificial Sequence
  Description of Artificial Sequence: Synthetic polypeptide
DENEIATTNPCAYAPWGATTVALATDGPAEPKIPQN

SEQ ID NO: 210909 - protein, 38 aa, Artificial Sequence
  Description of Artificial Sequence: Synthetic polypeptide
DENEIATTNPCAYAPWGCATTWANATDGPAEPKGPQNV

SEQ ID NO: 210910 - protein, 38 aa, Artificial Sequence
  Description of Artificial Sequence: Synthetic polypeptide
ADAEISTTNPVAYEHYGQCVCSNWGEHNAENFISDTQN

SEQ ID NO: 210911 - protein, 39 aa, Artificial Sequence
  Description of Artificial Sequence: Synthetic polypeptide
ADAEISTTNPVAYEQYGQCVCSNWEEDDNAENFISDTQS

SEQ ID NO: 210912 - protein, 39 aa, Artificial Sequence
  Description of Artificial Sequence: Synthetic polypeptide
ADAEISTTNPVAYEQYGQCVCSNWGEDHNQENFISQTQA

SEQ ID NO: 210913 - protein, 39 aa, Artificial Sequence
  Description of Artificial Sequence: Synthetic polypeptide
CEACISCTNPVATEQYGQCVCSNWGEDHNAENFSSDTQA

SEQ ID NO: 210914 - protein, 37 aa, Artificial Sequence
  Description of Artificial Sequence: Synthetic polypeptide
DETEIATTNPCAYEPWGTTTWANATDGPAEPKGSPQN

SEQ ID NO: 210915 - protein, 39 aa, Artificial Sequence
  Description of Artificial Sequence: Synthetic polypeptide
ADEAIATTNPVAYEQYGQCVCQNWGEDHNIEYFISETQA

SEQ ID NO: 210916 - protein, 39 aa, Artificial Sequence
  Description of Artificial Sequence: Synthetic polypeptide
CEACIRTTNPVAYEGWGQCVCSNWGEDNNIENFNSDTQS

SEQ ID NO: 210917 - protein, 36 aa, Artificial Sequence
  Description of Artificial Sequence: Synthetic polypeptide
DETEIATTNPCAYAPWGTTTYANATDGPAEPKGPQN

SEQ ID NO: 210918 - protein, 39 aa, Artificial Sequence
  Description of Artificial Sequence: Synthetic polypeptide
ADAEISTTNPVAYEGYGQCVCSNWGEDHNAEYFNSDTQP

SEQ ID NO: 210919 - protein, 39 aa, Artificial Sequence
  Description of Artificial Sequence: Synthetic polypeptide
DENCISTTNPVAYEYYGQCVCSNWGEDHNAENFISQTQL

SEQ ID NO: 210920 - protein, 39 aa, Artificial Sequence
  Description of Artificial Sequence: Synthetic polypeptide
AEEAISTTNPCATEGYGQCVCPNWEEDHNAEYFNSDNQF

SEQ ID NO: 210921 - protein, 39 aa, Artificial Sequence
  Description of Artificial Sequence: Synthetic polypeptide
ADEEISTTNPVATEGWGQCVCQNWGEDHNAENFISDTQQ

SEQ ID NO: 210922 - protein, 38 aa, Artificial Sequence
  Description of Artificial Sequence: Synthetic polypeptide
CEAEISTTNPCAYEGYGCICVNWGEEHNAENFNSQTQA

SEQ ID NO: 210923 - protein, 40 aa, Artificial Sequence
  Description of Artificial Sequence: Synthetic polypeptide
DEECISTTNPVAYEGYGICAVCQNWGEDHNIENFNSDNQF

SEQ ID NO: 210924 - protein, 39 aa, Artificial Sequence
  Description of Artificial Sequence: Synthetic polypeptide
FEIAEIRRFTNPVCTWQCGYSDYCQCTLLEQNVTFITQA

SEQ ID NO: 210925 - protein, 38 aa, Artificial Sequence
  Description of Artificial Sequence: Synthetic polypeptide
FEICHIYTTNPCLTEQYGYAVQLVPVGEDQPVGVEFPW

SEQ ID NO: 210926 - protein, 39 aa, Artificial Sequence
  Description of Artificial Sequence: Synthetic polypeptide
FENAEIRRGTNPVCTWQCGYSDMCQCTLLSQGIQFITQY

SEQ ID NO: 210927 - protein, 39 aa, Artificial Sequence
  Description of Artificial Sequence: Synthetic polypeptide
ADAEISTTNPVATEYYGQCVCSNWGEDDNAENFISETQS

SEQ ID NO: 210928 - protein, 37 aa, Artificial Sequence
  Description of Artificial Sequence: Synthetic polypeptide
DETEIATTNPIAYEPWGATTIANATDGPAEPKGSPQN

SEQ ID NO: 210929 - protein, 38 aa, Artificial Sequence
  Description of Artificial Sequence: Synthetic polypeptide
QEAEIACTNPVATEQWGCIWNAAMNNEEADPSMSEAGN

SEQ ID NO: 210930 - protein, 36 aa, Artificial Sequence
  Description of Artificial Sequence: Synthetic polypeptide
DETEIATTNPIAYAPWGTTTWANATDGPAEPKGPQK

SEQ ID NO: 210931 - protein, 42 aa, Artificial Sequence
  Description of Artificial Sequence: Synthetic polypeptide
DEGEAEIATTTTVYEAWAYEQWGAVASGESHKNMVDQGNDDR

SEQ ID NO: 210932 - protein, 40 aa, Artificial Sequence
  Description of Artificial Sequence: Synthetic polypeptide
DEECISTTNPVAYEGYGQCQVCGNWGEDHNAEGFISDTQA

SEQ ID NO: 210933 - protein, 41 aa, Artificial Sequence
  Description of Artificial Sequence: Synthetic polypeptide
VEDEIATTNPVAYYEPWAHSFVSAIADGALTQTRHGDSMDG

SEQ ID NO: 210934 - protein, 38 aa, Artificial Sequence
  Description of Artificial Sequence: Synthetic polypeptide
DETEIATTNPIAYAPWGPTTSANATDGPAEPKGSPQNH

SEQ ID NO: 210935 - protein, 37 aa, Artificial Sequence
  Description of Artificial Sequence: Synthetic polypeptide
DETEIATTNPIAYAPWGATTSANATDGPAEPKPSPQN

SEQ ID NO: 210936 - protein, 37 aa, Artificial Sequence
  Description of Artificial Sequence: Synthetic polypeptide
DETEIATTNPIAYAPWGATTAAMATDGPAEPKGPQNP

SEQ ID NO: 210937 - protein, 36 aa, Artificial Sequence
  Description of Artificial Sequence: Synthetic polypeptide
DETEIATTNPIAYAPWGATTAAGATHGPAEPKGPQN

SEQ ID NO: 210938 - protein, 40 aa, Artificial Sequence
  Description of Artificial Sequence: Synthetic polypeptide
ADEEISTTNPVATEGYGQCAVCSNWGEPHNAENFISDTQA

SEQ ID NO: 210939 - protein, 39 aa, Artificial Sequence
  Description of Artificial Sequence: Synthetic polypeptide
DETEIATTNPIATECWGHTYYANENDHQEHEKTGQKGMS

SEQ ID NO: 210940 - protein, 38 aa, Artificial Sequence
  Description of Artificial Sequence: Synthetic polypeptide
DEGEIACTNPVATEQWGCTTIFAGAGMHDPDDSGEGAE

SEQ ID NO: 210941 - protein, 38 aa, Artificial Sequence
  Description of Artificial Sequence: Synthetic polypeptide
DEGEIACTNPVATEQWGCTTIFAGAGMHKGPDDSGEGA

SEQ ID NO: 210942 - protein, 39 aa, Artificial Sequence
  Description of Artificial Sequence: Synthetic polypeptide
ADAEISTTNPVAYEGYGQCVCSNWEEDHNAEHFGSETQA

SEQ ID NO: 210943 - protein, 40 aa, Artificial Sequence
  Description of Artificial Sequence: Synthetic polypeptide
AEEAISTTNPCATEGYGQCQVCSNWGEDHNAEFFNSDNAA

SEQ ID NO: 210944 - protein, 39 aa, Artificial Sequence
  Description of Artificial Sequence: Synthetic polypeptide
SENEIATTNPVAYEGYGICVCSNWGEDDNQEHFISETQA

SEQ ID NO: 210945 - protein, 39 aa, Artificial Sequence
  Description of Artificial Sequence: Synthetic polypeptide
AEACIGTVNPVATEGYGQCSCSMWGEDHNIENFNSDNQA

SEQ ID NO: 210946 - protein, 40 aa, Artificial Sequence
  Description of Artificial Sequence: Synthetic polypeptide
AENEISTTNPVAYEQYGQCQVCSNWEEDHNAENFSSDTQA

SEQ ID NO: 210947 - protein, 40 aa, Artificial Sequence
  Description of Artificial Sequence: Synthetic polypeptide
AEMEISTTNPVAYEGYGQCAVCSNWGEPDNIENFNSDTQF

SEQ ID NO: 210948 - protein, 39 aa, Artificial Sequence
  Description of Artificial Sequence: Synthetic polypeptide
DDAEIACTNPVAYEGYGQCVCGNWGEDDNAEGFNSVFQA

SEQ ID NO: 210949 - protein, 39 aa, Artificial Sequence
  Description of Artificial Sequence: Synthetic polypeptide
AEMEISTTNPVAYEGYGQCICSNWGEDDNAENFNSENQL

SEQ ID NO: 210950 - protein, 39 aa, Artificial Sequence
  Description of Artificial Sequence: Synthetic polypeptide
SEEAISTTNPVAYEGYGQCVCSNWEEDDNAENFISDFQS

SEQ ID NO: 210951 - protein, 41 aa, Artificial Sequence
  Description of Artificial Sequence: Synthetic polypeptide
CTEASEIVICTTNPVAYEQWGSVCAMSGGGTQGSPDGSAMW

SEQ ID NO: 210952 - protein, 38 aa, Artificial Sequence
  Description of Artificial Sequence: Synthetic polypeptide
SEEAISCTNPVAYEGWGCVCFNWGEDTNIENFNSDTQS

SEQ ID NO: 210953 - protein, 39 aa, Artificial Sequence
  Description of Artificial Sequence: Synthetic polypeptide
DDACISTTNPVAYEQYGQCVCSNWGEDDNIEGFISDTQA

SEQ ID NO: 210954 - protein, 39 aa, Artificial Sequence
  Description of Artificial Sequence: Synthetic polypeptide
DDACISTTNPVAYEQYGQCVCSNWEEDHNAEHFISETQA

SEQ ID NO: 210955 - protein, 39 aa, Artificial Sequence
  Description of Artificial Sequence: Synthetic polypeptide
DDACISTTNPVAYEGYGQCVCSNWGEDPNIENFISENQN

SEQ ID NO: 210956 - protein, 39 aa, Artificial Sequence
  Description of Artificial Sequence: Synthetic polypeptide
DDACISTTNPVAYEGYGQCSCSNWEALHNAEYFNSDNQM

SEQ ID NO: 210957 - protein, 39 aa, Artificial Sequence
  Description of Artificial Sequence: Synthetic polypeptide
DDACISTTNPVAYEGYGICVCSNWGEDHNAENFNSDTQN

SEQ ID NO: 210958 - protein, 39 aa, Artificial Sequence
  Description of Artificial Sequence: Synthetic polypeptide
SEDEIATTNPVAYEPQWGGCTVAANNGGTTANPDDNSGH

SEQ ID NO: 210959 - protein, 40 aa, Artificial Sequence
  Description of Artificial Sequence: Synthetic polypeptide
AEMEISTTNPVAYEGYGQCAVCSNWGEDDNAEHFNSDTQS

SEQ ID NO: 210960 - protein, 39 aa, Artificial Sequence
  Description of Artificial Sequence: Synthetic polypeptide
DDACISTTNPVAYEEYGQCVCSNWGEGTNAEHFISETQS

SEQ ID NO: 210961 - protein, 39 aa, Artificial Sequence
  Description of Artificial Sequence: Synthetic polypeptide
SEEEISCTNPVAYEGYGQCVCSNWGEDHNAEFFISEPQA

SEQ ID NO: 210962 - protein, 40 aa, Artificial Sequence
  Description of Artificial Sequence: Synthetic polypeptide
AEMEISTTNPVAYEGYGQCQVCQYSGEDDNTEYFNSENQS

SEQ ID NO: 210963 - protein, 40 aa, Artificial Sequence
  Description of Artificial Sequence: Synthetic polypeptide
AEAEISTTNPVATEGYGQCQVCSNWGEPHNAENFISEFQS

SEQ ID NO: 210964 - protein, 40 aa, Artificial Sequence
  Description of Artificial Sequence: Synthetic polypeptide
AEAEISTTNPVATEGYGQCAVCFNWGEDHNAENFQSDTQP

SEQ ID NO: 210965 - protein, 40 aa, Artificial Sequence
  Description of Artificial Sequence: Synthetic polypeptide
AEMEISTTNPVAYEGYGQCQVCQYSGEDHNTENFISETQA

SEQ ID NO: 210966 - protein, 39 aa, Artificial Sequence
  Description of Artificial Sequence: Synthetic polypeptide
DDACISTTNPVATEGYGQCVCSNWGEPHNAENFISDTQP

SEQ ID NO: 210967 - protein, 39 aa, Artificial Sequence
  Description of Artificial Sequence: Synthetic polypeptide
SEAEISTTNPVSYEGYGQCVCSNWEEDHNAENFNSDTQN

SEQ ID NO: 210968 - protein, 39 aa, Artificial Sequence
  Description of Artificial Sequence: Synthetic polypeptide
DDACISTTNPVATEGYGQCVCSNWGEDHNAEFFISDTQG

SEQ ID NO: 210969 - protein, 39 aa, Artificial Sequence
  Description of Artificial Sequence: Synthetic polypeptide
AEAEISTTNPVATCGYGQCYCSNWGEDHNAENFNSDNQS

SEQ ID NO: 210970 - protein, 40 aa, Artificial Sequence
  Description of Artificial Sequence: Synthetic polypeptide
AEMEISTTNPVAYEGYGQCQVCSNWEEDHNAENFGSEFQS

SEQ ID NO: 210971 - protein, 40 aa, Artificial Sequence
  Description of Artificial Sequence: Synthetic polypeptide
DEMCISTTNPVATEAYGQCAVCYNWGEDHNAENFNSDTQS

SEQ ID NO: 210972 - protein, 40 aa, Artificial Sequence
  Description of Artificial Sequence: Synthetic polypeptide
AEAEISTTNPCATEQYGQCQVCGNWGEDHNAENFNSDNAA

SEQ ID NO: 210973 - protein, 39 aa, Artificial Sequence
  Description of Artificial Sequence: Synthetic polypeptide
DDACISTTNPVAYCQYGQCVCSNWGEDHNEEYFNSDTAN

SEQ ID NO: 210974 - protein, 39 aa, Artificial Sequence
  Description of Artificial Sequence: Synthetic polypeptide
DEECISCTNPCAYEQYGQCVCSNWGEDHNAENFISDTQA

SEQ ID NO: 210975 - protein, 38 aa, Artificial Sequence
  Description of Artificial Sequence: Synthetic polypeptide
CETEIACTNPVAYEQWGHCIFAGAENGNQAAAAPAGMN

SEQ ID NO: 210976 - protein, 40 aa, Artificial Sequence
  Description of Artificial Sequence: Synthetic polypeptide
DEACISTTNPVAYEHYGQCAVCSNWGEDDNAENFSSDNQS

SEQ ID NO: 210977 - protein, 38 aa, Artificial Sequence
  Description of Artificial Sequence: Synthetic polypeptide
DEMEISTTNPCAYEGWGCQTCGNWEEHNAEYSGSETQA

SEQ ID NO: 210978 - protein, 39 aa, Artificial Sequence
  Description of Artificial Sequence: Synthetic polypeptide
AEAEISTTNPVAYEGYGQCVCSMWEEDHNAENFMSDTQS

SEQ ID NO: 210979 - protein, 39 aa, Artificial Sequence
  Description of Artificial Sequence: Synthetic polypeptide
AEAEISTTNPVAYEGYGQCVCPTSGEDPNAENFISDTQA

SEQ ID NO: 210980 - protein, 39 aa, Artificial Sequence
  Description of Artificial Sequence: Synthetic polypeptide
AEAEISTTNPVAYEGYGQCVCGNSGEDDNAEFFPSDTQS

SEQ ID NO: 210981 - protein, 40 aa, Artificial Sequence
  Description of Artificial Sequence: Synthetic polypeptide
DEMEISCTNPVAYEQWGQCQVCFNWGEDTNIENFISDNQS

SEQ ID NO: 210982 - protein, 39 aa, Artificial Sequence
  Description of Artificial Sequence: Synthetic polypeptide
DEACISCTNPVATEGYGQCVCFNWGEDHNAENFISETQA

SEQ ID NO: 210983 - protein, 40 aa, Artificial Sequence
  Description of Artificial Sequence: Synthetic polypeptide
AEMEISCTNPVAYEQYGQCQVCSNWGPDHNAEGFNSDNQL

SEQ ID NO: 210984 - protein, 39 aa, Artificial Sequence
  Description of Artificial Sequence: Synthetic polypeptide
DEACISTTNPVAYEGYGQCVCSNWGEPHDAESFNSDTQS

SEQ ID NO: 210985 - protein, 40 aa, Artificial Sequence
  Description of Artificial Sequence: Synthetic polypeptide
DEACISCTNPVATEGYGQCQVCSTWGEDHNAENFISDTQS

SEQ ID NO: 210986 - protein, 40 aa, Artificial Sequence
  Description of Artificial Sequence: Synthetic polypeptide
AEAEISTTNPVAYEGYGQCQICSNWVEDHNAEFFTSDNQI

SEQ ID NO: 210987 - protein, 39 aa, Artificial Sequence
  Description of Artificial Sequence: Synthetic polypeptide
SEECISCTNPVAYEQYGQCVCGNWGEAHNAENFISETQA

SEQ ID NO: 210988 - protein, 39 aa, Artificial Sequence
  Description of Artificial Sequence: Synthetic polypeptide
AEMEISTTNPCAYEAYGQCVCQNWGALHNAENFISDNQS

SEQ ID NO: 210989 - protein, 40 aa, Artificial Sequence
  Description of Artificial Sequence: Synthetic polypeptide
AEAEISTTNPVAYEGYGQCAVCSNWGEPHNAENFNSEFQS

SEQ ID NO: 210990 - protein, 38 aa, Artificial Sequence
  Description of Artificial Sequence: Synthetic polypeptide
DESEIATTNPVAYYYAAWGCVAAAEHLEADLSGMGSKS

SEQ ID NO: 210991 - protein, 40 aa, Artificial Sequence
  Description of Artificial Sequence: Synthetic polypeptide
AEAEISTTNPVAYEGYGQCAVCSNWGEDDNAENFSSDNQS

SEQ ID NO: 210992 - protein, 38 aa, Artificial Sequence
  Description of Artificial Sequence: Synthetic polypeptide
EEGEIATTNPIATECWGATYYANENDHQLHEKTGKGMA

SEQ ID NO: 210993 - protein, 39 aa, Artificial Sequence
  Description of Artificial Sequence: Synthetic polypeptide
AEAEISTTNPVAYEGYGCQVCSNWEEDHNAENFISETQS

SEQ ID NO: 210994 - protein, 39 aa, Artificial Sequence
  Description of Artificial Sequence: Synthetic polypeptide
SEECIGCTNPVAYEEYGQCVCSNSGEDHNAEYFNSDNQS

SEQ ID NO: 210995 - protein, 40 aa, Artificial Sequence
  Description of Artificial Sequence: Synthetic polypeptide
DEMEISCTNPVATCGYGQCQVCQNSGEEHNAEGFNSDTQS

SEQ ID NO: 210996 - protein, 39 aa, Artificial Sequence
  Description of Artificial Sequence: Synthetic polypeptide
AEAEISTTNPVAYEGYGCAVCQNWGEDHNAENFISDTQS

SEQ ID NO: 210997 - protein, 39 aa, Artificial Sequence
  Description of Artificial Sequence: Synthetic polypeptide
AEAEISTTNPVAYEEYGQCVCSNWGEDPNAENFISDTQS

SEQ ID NO: 210998 - protein, 39 aa, Artificial Sequence
  Description of Artificial Sequence: Synthetic polypeptide
AEAEISTTNPVAYEAYGQCYCSNWGEDHNAENFNSDNQS

SEQ ID NO: 210999 - protein, 39 aa, Artificial Sequence
  Description of Artificial Sequence: Synthetic polypeptide
AEAEISTTNPVATEYWGQCVCGNWGEDHNAEYFNSDNQA

SEQ ID NO: 211000 - protein, 39 aa, Artificial Sequence
  Description of Artificial Sequence: Synthetic polypeptide
AEMEISTTNPCAYEGYGQCVCQNWGALDNAENFNSDTQA

SEQ ID NO: 211001 - protein, 39 aa, Artificial Sequence
  Description of Artificial Sequence: Synthetic polypeptide
AEMEISTTNPCAYEGYGQCVCQNWMELDNAENFNSDPQA

SEQ ID NO: 211002 - protein, 39 aa, Artificial Sequence
  Description of Artificial Sequence: Synthetic polypeptide
DEACISTTNPVAYEGYGQCYCSNWGEDHNAENFNSDTQS

SEQ ID NO: 211003 - protein, 39 aa, Artificial Sequence
  Description of Artificial Sequence: Synthetic polypeptide
DEECISCTNPCATEQWGQCVCGNWGEDHNAESFNSDTQA

SEQ ID NO: 211004 - protein, 39 aa, Artificial Sequence
  Description of Artificial Sequence: Synthetic polypeptide
AEAEISTTNPCATEGYGQCVCQNWGEDHNAEYFNSETQF

SEQ ID NO: 211005 - protein, 39 aa, Artificial Sequence
  Description of Artificial Sequence: Synthetic polypeptide
AEMEISCTNPVAYEGYGQCVCSNWGPDHNAEGFNSDNQA

SEQ ID NO: 211006 - protein, 40 aa, Artificial Sequence
  Description of Artificial Sequence: Synthetic polypeptide
AEAEISTTNPCATEAYGQCQVCSNWGEDHNAENFNSDTAS

SEQ ID NO: 211007 - protein, 40 aa, Artificial Sequence
  Description of Artificial Sequence: Synthetic polypeptide
DDACISTTNPVATEGYGQCIVCSNWGYDHNAENFNSENQL

SEQ ID NO: 211008 - protein, 39 aa, Artificial Sequence
  Description of Artificial Sequence: Synthetic polypeptide
DEMCISTTNPVAYEGYGQCVCSNWEEDHNIENFISDTQS

SEQ ID NO: 211009 - protein, 39 aa, Artificial Sequence
  Description of Artificial Sequence: Synthetic polypeptide
AEMEISTTNPVAYEGYGQCVCSNWGEDHNIESFISETQS

SEQ ID NO: 211010 - protein, 39 aa, Artificial Sequence
  Description of Artificial Sequence: Synthetic polypeptide
SEAEISCTNPVATEGWGQCVCFNWGEDTNIEYFNSDTQS

SEQ ID NO: 211011 - protein, 40 aa, Artificial Sequence
  Description of Artificial Sequence: Synthetic polypeptide
SEAEISCTNPVATEEYGQCQVCSNSGEDHNAEHFISDNQA

SEQ ID NO: 211012 - protein, 40 aa, Artificial Sequence
  Description of Artificial Sequence: Synthetic polypeptide
AEMEISTTNPVAYEQYGQCQVCGNWGEDDNAENFNSDTQI

SEQ ID NO: 211013 - protein, 39 aa, Artificial Sequence
  Description of Artificial Sequence: Synthetic polypeptide
SEMCISTTNPVAYEGYGQCVCSNWGEDHNAEGSNSDTQS

SEQ ID NO: 211014 - protein, 39 aa, Artificial Sequence
  Description of Artificial Sequence: Synthetic polypeptide
DEMCISTTNPVATEGWGQCVCGNWGEDHNIENFNSDTQA

SEQ ID NO: 211015 - protein, 40 aa, Artificial Sequence
  Description of Artificial Sequence: Synthetic polypeptide
SEMCISTTNPVAYEQYGQCQVCSNWGPDHNAENFNSDPQP

SEQ ID NO: 211016 - protein, 39 aa, Artificial Sequence
  Description of Artificial Sequence: Synthetic polypeptide
SEMCISTVNPVATEGYGQCVCSNSGEDHNAENFNSEPQA

SEQ ID NO: 211017 - protein, 40 aa, Artificial Sequence
  Description of Artificial Sequence: Synthetic polypeptide
AEEEISTTNPVAYEAYGQCAVCYNWGEDHNAEYFNSDTQS

SEQ ID NO: 211018 - protein, 40 aa, Artificial Sequence
  Description of Artificial Sequence: Synthetic polypeptide
DEMCISTTNPVAYEGYGQCQVCSNWGEDHNAEGFNSDTQS

SEQ ID NO: 211019 - protein, 40 aa, Artificial Sequence
  Description of Artificial Sequence: Synthetic polypeptide
SEAEIGTTNPVAYEEYGQCQSCSNWGEDHNTENSNSDTQA

SEQ ID NO: 211020 - protein, 39 aa, Artificial Sequence
  Description of Artificial Sequence: Synthetic polypeptide
CEECISCTNPVATEGYGQCVCSMWGEDHNAENFSSDTQP

SEQ ID NO: 211021 - protein, 39 aa, Artificial Sequence
  Description of Artificial Sequence: Synthetic polypeptide
DEACISTTNPVAYEYWGQCSCSNWMEDHNTENFSSDTQA

SEQ ID NO: 211022 - protein, 38 aa, Artificial Sequence
  Description of Artificial Sequence: Synthetic polypeptide
SEMEIACTNPCSYEQYGCVCSNWGEDHNQESFGSDTQA

SEQ ID NO: 211023 - protein, 40 aa, Artificial Sequence
  Description of Artificial Sequence: Synthetic polypeptide
DEECISTTNPCAYEGYGQCQVCSNWGEDDNDENFNSDNQS

SEQ ID NO: 211024 - protein, 39 aa, Artificial Sequence
  Description of Artificial Sequence: Synthetic polypeptide
DEECISTTNPCAYEQWGQCVCSNWGEDHNAENFISDTQL

SEQ ID NO: 211025 - protein, 39 aa, Artificial Sequence
  Description of Artificial Sequence: Synthetic polypeptide
DEEAISTTNPVAYEEWGQCVCSNWGEDHNAEFFISDTQS

SEQ ID NO: 211026 - protein, 39 aa, Artificial Sequence
  Description of Artificial Sequence: Synthetic polypeptide
DDACISCTNPVAYEQYGQCIVCSNWGYHNAESFNSETQL

SEQ ID NO: 211027 - protein, 39 aa, Artificial Sequence
  Description of Artificial Sequence: Synthetic polypeptide
AENAISCTNPVATEGYGQCVCSNWGEDDNTEHFNSDTQM

SEQ ID NO: 211028 - protein, 38 aa, Artificial Sequence
  Description of Artificial Sequence: Synthetic polypeptide
SEAEIACTNPVATEQWGCIWNAAMNNAEEADPSMSENN

SEQ ID NO: 211029 - protein, 40 aa, Artificial Sequence
  Description of Artificial Sequence: Synthetic polypeptide
DDECISTTNPVAYEGYGQCIVCSNWGADHNAESFNSETQL

SEQ ID NO: 211030 - protein, 39 aa, Artificial Sequence
  Description of Artificial Sequence: Synthetic polypeptide
AENAISTTNPVAYEGYGQCVCSNWMEDDNTEHFNSDNQM

SEQ ID NO: 211031 - protein, 40 aa, Artificial Sequence
  Description of Artificial Sequence: Synthetic polypeptide
DDACISCTNPVATEQYGQCQVCSNWGEDDNAEGFNSDTQI

SEQ ID NO: 211032 - protein, 39 aa, Artificial Sequence
  Description of Artificial Sequence: Synthetic polypeptide
DDACISCTNPVATEGYGQCVCGNWGEDDNAEGFNSDTQI

SEQ ID NO: 211033 - protein, 39 aa, Artificial Sequence
  Description of Artificial Sequence: Synthetic polypeptide
DDACIRTVNPVATEGYGQCVCGNWGEDHNAENFNSDTQQ

SEQ ID NO: 211034 - protein, 39 aa, Artificial Sequence
  Description of Artificial Sequence: Synthetic polypeptide
DEECISCTNPVAYEYWGQCVCFNWGEDTNIEYFNSDTQS

SEQ ID NO: 211035 - protein, 39 aa, Artificial Sequence
  Description of Artificial Sequence: Synthetic polypeptide
AEAEIGTVNPVAYEGYGQCSCSMWGEDHNIEYFNSDTQA

SEQ ID NO: 211036 - protein, 39 aa, Artificial Sequence
  Description of Artificial Sequence: Synthetic polypeptide
SEMCISTTNPVATEGYGQCVCSNWGEDHDAESFNSDNQS

SEQ ID NO: 211037 - protein, 39 aa, Artificial Sequence
  Description of Artificial Sequence: Synthetic polypeptide
AEMEISTTNPVAYEGYGQCVCGNWGEDHNAENFNSDNQI

SEQ ID NO: 211038 - protein, 39 aa, Artificial Sequence
  Description of Artificial Sequence: Synthetic polypeptide
DDACISTTNPVATEGYGQCICSNWGEDHNTEGFGSDTQS

SEQ ID NO: 211039 - protein, 39 aa, Artificial Sequence
  Description of Artificial Sequence: Synthetic polypeptide
AEAEISCTNPVAYEQWGQCVCFNWGEDTNIENFNSDTQS

SEQ ID NO: 211040 - protein, 39 aa, Artificial Sequence
  Description of Artificial Sequence: Synthetic polypeptide
AEAEISCTNPVAYEGYGQCVCSMWMEDDNAENFNSDTQS

SEQ ID NO: 211041 - protein, 39 aa, Artificial Sequence
  Description of Artificial Sequence: Synthetic polypeptide
AEAEISCTNPVAYEGYGQCSCSNWEELHNAEHFNSDNQS

SEQ ID NO: 211042 - protein, 39 aa, Artificial Sequence
  Description of Artificial Sequence: Synthetic polypeptide
AEAEISCTNPVAYEGYGQCSCSNWEADHNAEHFNSDTQA

SEQ ID NO: 211043 - protein, 39 aa, Artificial Sequence
  Description of Artificial Sequence: Synthetic polypeptide
DDMCISTTNPVAYEGYGQCVCSMWGEDHNAEFFNSQNQS

SEQ ID NO: 211044 - protein, 39 aa, Artificial Sequence
  Description of Artificial Sequence: Synthetic polypeptide
AEAEISCTNPVAYEEYGQCVCSNSGEDHNAEYFNSDNQS

SEQ ID NO: 211045 - protein, 39 aa, Artificial Sequence
  Description of Artificial Sequence: Synthetic polypeptide
AEAEISCTNPVAYEAYGQCVCQNWGEWPNAEGFNSDNQA

SEQ ID NO: 211046 - protein, 39 aa, Artificial Sequence
  Description of Artificial Sequence: Synthetic polypeptide
AEMEISTTNPVAYEGYGQCQVCSNWEEHNAENFISETQS

SEQ ID NO: 211047 - protein, 38 aa, Artificial Sequence
  Description of Artificial Sequence: Synthetic polypeptide
SEGEIATTNPVAYEQWGHCIIFAGNSGLVDNDSETTAM

SEQ ID NO: 211048 - protein, 39 aa, Artificial Sequence
  Description of Artificial Sequence: Synthetic polypeptide
DDACISTTNPCATEQWGQCVCQNWGEGNNAEYFNSDPQL

SEQ ID NO: 211049 - protein, 39 aa, Artificial Sequence
  Description of Artificial Sequence: Synthetic polypeptide
AEAEISCTNPVATEGYGQCVCSNWGEDHNAENFMSDTQS

SEQ ID NO: 211050 - protein, 39 aa, Artificial Sequence
  Description of Artificial Sequence: Synthetic polypeptide
SEAEISTTNPVAYEGYGQCYCSNWGEDHNAENFNSDNQS

SEQ ID NO: 211051 - protein, 40 aa, Artificial Sequence
  Description of Artificial Sequence: Synthetic polypeptide
DESEIATTNPVATEQWGCTNNQANMNGVDTATAGPDEEWP

SEQ ID NO: 211052 - protein, 39 aa, Artificial Sequence
  Description of Artificial Sequence: Synthetic polypeptide
AEAEISCTNPVATEGYGQCVCGNWGEDHNAENFNSDTQI

SEQ ID NO: 211053 - protein, 38 aa, Artificial Sequence
  Description of Artificial Sequence: Synthetic polypeptide
SEHEIATTNPVAYAPPWGVTSGTGEPLGIAHAGDYSDA

SEQ ID NO: 211054 - protein, 39 aa, Artificial Sequence
  Description of Artificial Sequence: Synthetic polypeptide
AEAEISCTNPCATEGYGQCVCQNWGALDNAENFNSDTQA

SEQ ID NO: 211055 - protein, 38 aa, Artificial Sequence
  Description of Artificial Sequence: Synthetic polypeptide
DETEISTTNPCAYEGWGCQTCQNWEEDNAEHSGSDNQS

SEQ ID NO: 211056 - protein, 39 aa, Artificial Sequence
  Description of Artificial Sequence: Synthetic polypeptide
SEAEISTTNPVAYEGYGQCVCSNWGEDHNIEGFISDTQA

SEQ ID NO: 211057 - protein, 39 aa, Artificial Sequence
  Description of Artificial Sequence: Synthetic polypeptide
SEAEISTTNPVAYEGYGQCVCSNWGEDHNAENFISDTQA

SEQ ID NO: 211058 - protein, 39 aa, Artificial Sequence
  Description of Artificial Sequence: Synthetic polypeptide
SEAEISTTNPVAYEGYGQCVCSNWEEDHNIENFISDPQA

SEQ ID NO: 211059 - protein, 38 aa, Artificial Sequence
  Description of Artificial Sequence: Synthetic polypeptide
DETEISTTNPCATEGWGCQTCQNAEEDNAENSISDNIS

SEQ ID NO: 211060 - protein, 38 aa, Artificial Sequence
  Description of Artificial Sequence: Synthetic polypeptide
SELAIAYTETNPVAYESWGTTAYYTWNHDQDKKKNTDH

SEQ ID NO: 211061 - protein, 39 aa, Artificial Sequence
  Description of Artificial Sequence: Synthetic polypeptide
SEAEISTTNPVAYEGYGQCVCPNWGEDHNAENFISQFQS

SEQ ID NO: 211062 - protein, 39 aa, Artificial Sequence
  Description of Artificial Sequence: Synthetic polypeptide
SEAEISTTNPVAYEGYGQCVCGNWVEDHNAENFNSDPQL

SEQ ID NO: 211063 - protein, 40 aa, Artificial Sequence
  Description of Artificial Sequence: Synthetic polypeptide
SEAEISTTNPVAYEGYGQCAVCSNWGELHNAENFNSDTQS

SEQ ID NO: 211064 - protein, 36 aa, Artificial Sequence
  Description of Artificial Sequence: Synthetic polypeptide
SEMCIACTNPCSYEGYGCVCSWGEHNQESFGSDTQA

SEQ ID NO: 211065 - protein, 37 aa, Artificial Sequence
  Description of Artificial Sequence: Synthetic polypeptide
SEESICTNVATEGYGNVATTQYGNVAEIYGVIPELLE

SEQ ID NO: 211066 - protein, 39 aa, Artificial Sequence
  Description of Artificial Sequence: Synthetic polypeptide
SEACISTTNPVAYEQYGQCVCPNWGEDHNAENFQSDTQI

SEQ ID NO: 211067 - protein, 39 aa, Artificial Sequence
  Description of Artificial Sequence: Synthetic polypeptide
AEAEISTTNPVAYEGYGQCVCSNSGEDHNAENFISDTQA

SEQ ID NO: 211068 - protein, 39 aa, Artificial Sequence
  Description of Artificial Sequence: Synthetic polypeptide
AEAEISTTNPVAYEGYGQCVCSNSGEDHNAESFISDTQP

SEQ ID NO: 211069 - protein, 39 aa, Artificial Sequence
  Description of Artificial Sequence: Synthetic polypeptide
AEMEIACTNPVGTEGYGQCSCQNSGEDDNQEHFGSDTQA

SEQ ID NO: 211070 - protein, 39 aa, Artificial Sequence
  Description of Artificial Sequence: Synthetic polypeptide
DEACISTTNPVAYCGYGQCAVCSNWGEDNAENFNSDNQS

SEQ ID NO: 211071 - protein, 39 aa, Artificial Sequence
  Description of Artificial Sequence: Synthetic polypeptide
DEACISTTNPVATEYWGQCVCGNWGEDHNAEYFNSDTQA

SEQ ID NO: 211072 - protein, 40 aa, Artificial Sequence
  Description of Artificial Sequence: Synthetic polypeptide
DDMEISTTNPVAYEGYGQCAVCSNWEEDHNAEYFNSEFQS

SEQ ID NO: 211073 - protein, 40 aa, Artificial Sequence
  Description of Artificial Sequence: Synthetic polypeptide
DDMEISTTNPVAYEGYGQCQVCSNWEEDHNAENFGSETQS

SEQ ID NO: 211074 - protein, 40 aa, Artificial Sequence
  Description of Artificial Sequence: Synthetic polypeptide
QEEEIATTNPVATEQWGCTNNQANMNGVDTATAVADEEWP

SEQ ID NO: 211075 - protein, 40 aa, Artificial Sequence
  Description of Artificial Sequence: Synthetic polypeptide
AEMCISCTNPVAYEQYGECQVCSTWGEDDNAENFNSDTQS

SEQ ID NO: 211076 - protein, 40 aa, Artificial Sequence
  Description of Artificial Sequence: Synthetic polypeptide
DEAEISTTNPVAYEGYGQCQVCSNWEEDHNAEYFISETQS

SEQ ID NO: 211077 - protein, 40 aa, Artificial Sequence
  Description of Artificial Sequence: Synthetic polypeptide
DEAEISTTNPVAYEGYGQCQVCSNWGEDHNAENFISDTQS

SEQ ID NO: 211078 - protein, 39 aa, Artificial Sequence
  Description of Artificial Sequence: Synthetic polypeptide
AEMCISCTNPVATEQYGQCVCGNWGEDHNAENFNSDTQI

SEQ ID NO: 211079 - protein, 39 aa, Artificial Sequence
  Description of Artificial Sequence: Synthetic polypeptide
AEMCISCTNPVATEGYGQCVCSNWGEDHNAENFQSDTQP

SEQ ID NO: 211080 - protein, 39 aa, Artificial Sequence
  Description of Artificial Sequence: Synthetic polypeptide
AEMCIGTTNPVAYEGYGQCVCQNWGEDHNTENFFSDNQQ

SEQ ID NO: 211081 - protein, 39 aa, Artificial Sequence
  Description of Artificial Sequence: Synthetic polypeptide
DTEGDQVNCCTNPVAYEQWGSVAITGANGNAHPGDLAVM

SEQ ID NO: 211082 - protein, 39 aa, Artificial Sequence
  Description of Artificial Sequence: Synthetic polypeptide
DDNCIATTNPCATEGYGQCVCSNWGEDHNAENFNSDPQS

SEQ ID NO: 211083 - protein, 39 aa, Artificial Sequence
  Description of Artificial Sequence: Synthetic polypeptide
AEMAISTTNPVAYEQYGQCVCSNWGEDHNAEGFISDTQS

SEQ ID NO: 211084 - protein, 39 aa, Artificial Sequence
  Description of Artificial Sequence: Synthetic polypeptide
AEMAISTTNPVAYEQWGCQVCSNWGEDHNAENSNSETQS

SEQ ID NO: 211085 - protein, 40 aa, Artificial Sequence
  Description of Artificial Sequence: Synthetic polypeptide
CEECIRTTNPVAYEGWGQCISCSMSGEDHNAENFNSDTQA

SEQ ID NO: 211086 - protein, 39 aa, Artificial Sequence
  Description of Artificial Sequence: Synthetic polypeptide
DEMCISCTNPVATEGWGQCVCFNWGEDTNIEYFNSDTQS

SEQ ID NO: 211087 - protein, 39 aa, Artificial Sequence
  Description of Artificial Sequence: Synthetic polypeptide
DEMCISTTNPCAYEQYGQCVCQNWGEDHNAENFNSETQF

SEQ ID NO: 211088 - protein, 39 aa, Artificial Sequence
  Description of Artificial Sequence: Synthetic polypeptide
AEMAISCTNPVATEGYGQCVCSNWPEDHNAENFNSQNQS

SEQ ID NO: 211089 - protein, 40 aa, Artificial Sequence
  Description of Artificial Sequence: Synthetic polypeptide
AEMAIGTTNPCATEQWGQCQVCSNWMEDTNIENFNSDNQA

SEQ ID NO: 211090 - protein, 39 aa, Artificial Sequence
  Description of Artificial Sequence: Synthetic polypeptide
AEMAIATTNPVAYEGYGQCSCQNWEALDNAEYFNSDTQA

SEQ ID NO: 211091 - protein, 40 aa, Artificial Sequence
  Description of Artificial Sequence: Synthetic polypeptide
DDAEISTTNPVAYEHYGQCQVCSNWGEDDNAENFISDNQS

SEQ ID NO: 211092 - protein, 40 aa, Artificial Sequence
  Description of Artificial Sequence: Synthetic polypeptide
DDECIRTTNPVAYEGWGQCIVCSNWGEDHNAESFNSETQA

SEQ ID NO: 211093 - protein, 40 aa, Artificial Sequence
  Description of Artificial Sequence: Synthetic polypeptide
DDECIRTTNPVAYEGYGQCIVCGNWGYDHNAESFNSETQL

SEQ ID NO: 211094 - protein, 39 aa, Artificial Sequence
  Description of Artificial Sequence: Synthetic polypeptide
DEMCISCTNPVATEGWGQCVCFNWGEDTNIENFISDNQS

SEQ ID NO: 211095 - protein, 40 aa, Artificial Sequence
  Description of Artificial Sequence: Synthetic polypeptide
DDMCIRTTNPVAYEGYGQCIVCSNWGEDHNAESFNSETQS

SEQ ID NO: 211096 - protein, 39 aa, Artificial Sequence
  Description of Artificial Sequence: Synthetic polypeptide
AEMCISTTNPCAYEQYGQCVCQNWGALHNAENFISDTQS

SEQ ID NO: 211097 - protein, 39 aa, Artificial Sequence
  Description of Artificial Sequence: Synthetic polypeptide
DDMCISTTNPVATEYWGQCSCSNSGEDHNTENFSSDTQA

SEQ ID NO: 211098 - protein, 39 aa, Artificial Sequence
  Description of Artificial Sequence: Synthetic polypeptide
AEMCISTTNPVATEGYGQCVCGNWGEAHNAENFNSDTQI

SEQ ID NO: 211099 - protein, 40 aa, Artificial Sequence
  Description of Artificial Sequence: Synthetic polypeptide
DDMCISTTNPVAYEQYGQCISCSNWGYDHNAESFNSETQL

SEQ ID NO: 211100 - protein, 39 aa, Artificial Sequence
  Description of Artificial Sequence: Synthetic polypeptide
AEMCISTTNPVAYEQYGQCVCSNWGEDHNAENFISEFQA

SEQ ID NO: 211101 - protein, 39 aa, Artificial Sequence
  Description of Artificial Sequence: Synthetic polypeptide
DDAEISTTNPVAYEQWGQCVCSNWMEDHNAENFISDTQD

SEQ ID NO: 211102 - protein, 39 aa, Artificial Sequence
  Description of Artificial Sequence: Synthetic polypeptide
DEACISTTNPVAYEGYGQCVCFNWGEDHNAENFISETQS

SEQ ID NO: 211103 - protein, 39 aa, Artificial Sequence
  Description of Artificial Sequence: Synthetic polypeptide
AEMCISTTNPVAYEQYGQCVCGNWGEDHNAEYFNSDNQI

SEQ ID NO: 211104 - protein, 40 aa, Artificial Sequence
  Description of Artificial Sequence: Synthetic polypeptide
DEACISTTNPVAYEGYGQCQVCSNWGEDHNAEYFNSDNQN

SEQ ID NO: 211105 - protein, 40 aa, Artificial Sequence
  Description of Artificial Sequence: Synthetic polypeptide
DEACISTTNPVAYEGYGQCQVCQYSGEDDNTEYFISENQS

SEQ ID NO: 211106 - protein, 40 aa, Artificial Sequence
  Description of Artificial Sequence: Synthetic polypeptide
DEACISTTNPVAYEGYGQCQVCQYSGEDDNTENFISETQA

SEQ ID NO: 211107 - protein, 40 aa, Artificial Sequence
  Description of Artificial Sequence: Synthetic polypeptide
DEACISTTNPVAYEGYGQCAVCSNWGEDDNAENFSSDNQS

SEQ ID NO: 211108 - protein, 40 aa, Artificial Sequence
  Description of Artificial Sequence: Synthetic polypeptide
DEACISTTNPVAYEGYGQCAVCSNWGEAHNAEYFNSDTQA

SEQ ID NO: 211109 - protein, 39 aa, Artificial Sequence
  Description of Artificial Sequence: Synthetic polypeptide
AEMCISTTNPVAYEGYGQCVCSNWGEEHNTENFNSDPQS

SEQ ID NO: 211110 - protein, 39 aa, Artificial Sequence
  Description of Artificial Sequence: Synthetic polypeptide
AEMCISTTNPVAYEGYGQCVCSNWGEDHNAEYFNSDTQP

SEQ ID NO: 211111 - protein, 39 aa, Artificial Sequence
  Description of Artificial Sequence: Synthetic polypeptide
AEMCISTTNPVAYEGYGQCVCSNWEEDTNIENFISDTQS

SEQ ID NO: 211112 - protein, 39 aa, Artificial Sequence
  Description of Artificial Sequence: Synthetic polypeptide
DEMCISCTNPVAYEQWGQCVCFNWGEDTNIENFNSDTQS

SEQ ID NO: 211113 - protein, 40 aa, Artificial Sequence
  Description of Artificial Sequence: Synthetic polypeptide
AEMCISTTNPVAYEGYGICQVCSNWEEDTNAEHFNSDTQS

SEQ ID NO: 211114 - protein, 40 aa, Artificial Sequence
  Description of Artificial Sequence: Synthetic polypeptide
DEACISTTNPVAYEGYGQCAVCSNSGEDDNAEYFNSDTQS

SEQ ID NO: 211115 - protein, 40 aa, Artificial Sequence
  Description of Artificial Sequence: Synthetic polypeptide
DEMCISCTNPVAYEGYGICQVCSNWEEDTNAENFISDNQS

SEQ ID NO: 211116 - protein, 40 aa, Artificial Sequence
  Description of Artificial Sequence: Synthetic polypeptide
DEAEISTTNPVAYEGYGQCQTCSNWGEDPNAENFNSDNQS

SEQ ID NO: 211117 - protein, 39 aa, Artificial Sequence
  Description of Artificial Sequence: Synthetic polypeptide
DEACISTTNPVAYEEYGQCVCSNWGEDHNAENFTSDTQP

SEQ ID NO: 211118 - protein, 39 aa, Artificial Sequence
  Description of Artificial Sequence: Synthetic polypeptide
DEACISTTNPVAYEEYGQCVCSNWGEDHNAENFISDTQP

SEQ ID NO: 211119 - protein, 39 aa, Artificial Sequence
  Description of Artificial Sequence: Synthetic polypeptide
DEACISTTNPVAYEEYGQCVCSNSGEAHNAENFISETQS

SEQ ID NO: 211120 - protein, 37 aa, Artificial Sequence
  Description of Artificial Sequence: Synthetic polypeptide
ECTEIATTNPIATECWGATYYANEEHNQIDEKKGKTM

SEQ ID NO: 211121 - protein, 39 aa, Artificial Sequence
  Description of Artificial Sequence: Synthetic polypeptide
DEACISTTNPVAYEEYGQCVCNNWGEDHNAEFFISDTQS

SEQ ID NO: 211122 - protein, 39 aa, Artificial Sequence
  Description of Artificial Sequence: Synthetic polypeptide
DDMEISCTNPVATEGWGQCVCFNWGEDTNIENFNSDNQS

SEQ ID NO: 211123 - protein, 39 aa, Artificial Sequence
  Description of Artificial Sequence: Synthetic polypeptide
DEMCISCTNPVAYCQYGCQVCQNSGEEHNAEGFNSDTQS

SEQ ID NO: 211124 - protein, 39 aa, Artificial Sequence
  Description of Artificial Sequence: Synthetic polypeptide
DDMEISCTNPVAYCQYGQCIVCSNWGEHNAENFNSDTQS

SEQ ID NO: 211125 - protein, 39 aa, Artificial Sequence
  Description of Artificial Sequence: Synthetic polypeptide
DDMEISCTNPVAYEGYGQCVCSMWGEDHNAEFFNSQTQS

SEQ ID NO: 211126 - protein, 39 aa, Artificial Sequence
  Description of Artificial Sequence: Synthetic polypeptide
DEAEISTTNPVAYEGWGQCVCGNWGEDDNIENFNSDTQA

SEQ ID NO: 211127 - protein, 39 aa, Artificial Sequence
  Description of Artificial Sequence: Synthetic polypeptide
AEMEISCTNPVAYEGYGQCVCSNWGEDDNIEGFNSDNQL

SEQ ID NO: 211128 - protein, 39 aa, Artificial Sequence
  Description of Artificial Sequence: Synthetic polypeptide
CEEAISTTNPVAYEGYGCIVCSNWGEDHDAENFPSDTQS

SEQ ID NO: 211129 - protein, 37 aa, Artificial Sequence
  Description of Artificial Sequence: Synthetic polypeptide
DEEEMRGTQQDTAVDQAQVNPTLSDLPNMQAEGNLES

SEQ ID NO: 211130 - protein, 39 aa, Artificial Sequence
  Description of Artificial Sequence: Synthetic polypeptide
DEACISCTNPVAYEQYGQCVCFNWMEDHNAENFISETQS

SEQ ID NO: 211131 - protein, 39 aa, Artificial Sequence
  Description of Artificial Sequence: Synthetic polypeptide
AEMEISCTNPCAYEQYGQCVCSNSGEAHNAESFNSDNQS

SEQ ID NO: 211132 - protein, 38 aa, Artificial Sequence
  Description of Artificial Sequence: Synthetic polypeptide
DQAEISTTNPVAYEGYGCCCSNWGEDHNAEHFSSDTQA

SEQ ID NO: 211133 - protein, 39 aa, Artificial Sequence
  Description of Artificial Sequence: Synthetic polypeptide
AEMEISCTNPVATEGWGQCVCFNWGEDTNIENFNSDTQS

SEQ ID NO: 211134 - protein, 40 aa, Artificial Sequence
  Description of Artificial Sequence: Synthetic polypeptide
AEEEISTTNPVAYEGYGQCQYCSNWGEDDNIENFNSDTQS

SEQ ID NO: 211135 - protein, 42 aa, Artificial Sequence
  Description of Artificial Sequence: Synthetic polypeptide
DNTMNEIRTTNPVATEQYDGYWCSDGAQADEEQHQGGLVDFF

SEQ ID NO: 211136 - protein, 40 aa, Artificial Sequence
  Description of Artificial Sequence: Synthetic polypeptide
AEEEISTTNPVAYEGYGQCQVCSNWGEDHNIENFISDTQI

SEQ ID NO: 211137 - protein, 40 aa, Artificial Sequence
  Description of Artificial Sequence: Synthetic polypeptide
AEEEISTTNPVAYEGYGQCAVCSNWGEDDNAENFPSETQM

SEQ ID NO: 211138 - protein, 39 aa, Artificial Sequence
  Description of Artificial Sequence: Synthetic polypeptide
DEACISCTNPVAYEGYGQCVCSNWGEDDNAENFNSDTQN

SEQ ID NO: 211139 - protein, 39 aa, Artificial Sequence
  Description of Artificial Sequence: Synthetic polypeptide
DEACISCTNPVAYEGYGQCVCSNWGEAHNAEGFNSDTQS

SEQ ID NO: 211140 - protein, 39 aa, Artificial Sequence
  Description of Artificial Sequence: Synthetic polypeptide
DEACISCTNPVAYEGYGQCVCGNWMEDDNAEGFNSDTQI

SEQ ID NO: 211141 - protein, 40 aa, Artificial Sequence
  Description of Artificial Sequence: Synthetic polypeptide
SEECISTTNPVAYEQYGQCQVCYNWEEDHNAEYFNSETQA

SEQ ID NO: 211142 - protein, 39 aa, Artificial Sequence
  Description of Artificial Sequence: Synthetic polypeptide
DEACISCTNPVAYEYYGCQCCSNWGADHNTENFNSDNQP

SEQ ID NO: 211143 - protein, 39 aa, Artificial Sequence
  Description of Artificial Sequence: Synthetic polypeptide
DEACISCTNPVAYEGYGQCSCQNWEALHNAEHFNSDNQS

SEQ ID NO: 211144 - protein, 39 aa, Artificial Sequence
  Description of Artificial Sequence: Synthetic polypeptide
SEECISTTNPVAYEGYGQCVCSNWGEDHNAENFPSDTQP

SEQ ID NO: 211145 - protein, 39 aa, Artificial Sequence
  Description of Artificial Sequence: Synthetic polypeptide
DEACISCTNPVAYEEYGQCVCSNSGEDHNAEHFISDNQA

SEQ ID NO: 211146 - protein, 39 aa, Artificial Sequence
  Description of Artificial Sequence: Synthetic polypeptide
AEAEISTTNPVAYEGYGQCYCSNWGEDPNAENFNSDTQS

SEQ ID NO: 211147 - protein, 39 aa, Artificial Sequence
  Description of Artificial Sequence: Synthetic polypeptide
DEACISCTNPVAYCQYGQCVCSNWGEDDNAENFNSEFQQ

SEQ ID NO: 211148 - protein, 39 aa, Artificial Sequence
  Description of Artificial Sequence: Synthetic polypeptide
DDAEISTTNPCAYEGYGQCVCSNWGEDHNAESFNSDNAP

SEQ ID NO: 211149 - protein, 39 aa, Artificial Sequence
  Description of Artificial Sequence: Synthetic polypeptide
SEECISTTNPVAYEGYGQCVCGNWGEEDNTENFNSDPQS

SEQ ID NO: 211150 - protein, 39 aa, Artificial Sequence
  Description of Artificial Sequence: Synthetic polypeptide
DDAEISCTNPVAYEQYGQCVCSNWGEDDNAEGFISETQS

SEQ ID NO: 211151 - protein, 39 aa, Artificial Sequence
  Description of Artificial Sequence: Synthetic polypeptide
DDAEISCTNPVAYEGYGQCSCSNWEELHNAEHFNSDTQA

SEQ ID NO: 211152 - protein, 39 aa, Artificial Sequence
  Description of Artificial Sequence: Synthetic polypeptide
DDAEISCTNPVAYCQYGQCVCSNWGEGDNAENFNSENQQ

SEQ ID NO: 211153 - protein, 39 aa, Artificial Sequence
  Description of Artificial Sequence: Synthetic polypeptide
AEAEISTTNPVAYEGYGQCVCSNWGEDDNAENFPSETQS

SEQ ID NO: 211154 - protein, 39 aa, Artificial Sequence
  Description of Artificial Sequence: Synthetic polypeptide
SEECISTTNPVAYEEYGQCVCSNWGEDHNAEFFISDTQL

SEQ ID NO: 211155 - protein, 39 aa, Artificial Sequence
  Description of Artificial Sequence: Synthetic polypeptide
SEECISTTNPVAYEAYGQCVCGNWGEDHNAEHSNSDNQS

SEQ ID NO: 211156 - protein, 40 aa, Artificial Sequence
  Description of Artificial Sequence: Synthetic polypeptide
DEACISCTNPVAYEGYGQCQVCSNWMEDPNTENFLSDNQS

SEQ ID NO: 211157 - protein, 37 aa, Artificial Sequence
  Description of Artificial Sequence: Synthetic polypeptide
DDSCVACTNPVSTEGYGCVCFNWGEHNQEYFGSQTQA

SEQ ID NO: 211158 - protein, 40 aa, Artificial Sequence
  Description of Artificial Sequence: Synthetic polypeptide
DEACISTTNPCAYEQYGQCQVCSNSEADDNAENFNSDTQS

SEQ ID NO: 211159 - protein, 40 aa, Artificial Sequence
  Description of Artificial Sequence: Synthetic polypeptide
DEACISTTNPVATEAYGQCQVCGNWGEDHNAEHSNSDNQS

SEQ ID NO: 211160 - protein, 39 aa, Artificial Sequence
  Description of Artificial Sequence: Synthetic polypeptide
CEEEIACTNPVATEQWGTNCIATGGMEGTTTHPMDLAVM

SEQ ID NO: 211161 - protein, 39 aa, Artificial Sequence
  Description of Artificial Sequence: Synthetic polypeptide
CEEEIACTNPVATEQWGTNYCIATGGMGETTHPMDLAVM

SEQ ID NO: 211162 - protein, 39 aa, Artificial Sequence
  Description of Artificial Sequence: Synthetic polypeptide
DDAEISTTNPVAYEGYGQCVCSNWGEDHNAEFFFSDTQA

SEQ ID NO: 211163 - protein, 40 aa, Artificial Sequence
  Description of Artificial Sequence: Synthetic polypeptide
DEAEISTTNPVAYEEYGQCQVCSNWGEDHNEEFFSSDTQS

SEQ ID NO: 211164 - protein, 39 aa, Artificial Sequence
  Description of Artificial Sequence: Synthetic polypeptide
DDAEISTTNPVAYEGYGQCVCSNWEEDHNAEFFISDTQN

SEQ ID NO: 211165 - protein, 39 aa, Artificial Sequence
  Description of Artificial Sequence: Synthetic polypeptide
DDAEISTTNPVAYEGYGQCVCSNSGEDPNAENFPSDTQP

SEQ ID NO: 211166 - protein, 38 aa, Artificial Sequence
  Description of Artificial Sequence: Synthetic polypeptide
DDMAISTTNPVAYEGYGQCICSNWGEDNAENFNSDTQG

SEQ ID NO: 211167 - protein, 39 aa, Artificial Sequence
  Description of Artificial Sequence: Synthetic polypeptide
DDMAISTTNPVATEGYGQCICSNWGEDHNAENFNSDTQG

SEQ ID NO: 211168 - protein, 39 aa, Artificial Sequence
  Description of Artificial Sequence: Synthetic polypeptide
DEMCIVTTNPVAYEGYGQCVCSNWGEDPNAEFFISDTQA

SEQ ID NO: 211169 - protein, 39 aa, Artificial Sequence
  Description of Artificial Sequence: Synthetic polypeptide
DDEEISCTNPVAYEGYGQCVCSNWGEDHNAEGFISDTQA

SEQ ID NO: 211170 - protein, 39 aa, Artificial Sequence
  Description of Artificial Sequence: Synthetic polypeptide
DDMAIRTTNPVAYEQWGQCICSNWGEDHNAENFNSDTQG

SEQ ID NO: 211171 - protein, 39 aa, Artificial Sequence
  Description of Artificial Sequence: Synthetic polypeptide
DDNEISTTNPVAYEGYGQCVCSNWGEDHNIEYFMSDTQA

SEQ ID NO: 211172 - protein, 39 aa, Artificial Sequence
  Description of Artificial Sequence: Synthetic polypeptide
DDAEISTTNPVAYEGYGQCVCSMWGEDHNAENFSSQTQS

SEQ ID NO: 211173 - protein, 39 aa, Artificial Sequence
  Description of Artificial Sequence: Synthetic polypeptide
DEACISTTNPVAYEGYGQCVCSMWEEDHNAENFISDTQA

SEQ ID NO: 211174 - protein, 39 aa, Artificial Sequence
  Description of Artificial Sequence: Synthetic polypeptide
DEACISTTNPVAYEGYGQCVCSMWGEDHNAENFISDFQI

SEQ ID NO: 211175 - protein, 39 aa, Artificial Sequence
  Description of Artificial Sequence: Synthetic polypeptide
DEACISTTNPVAYEGYGQCVCSNWGEDHNAEGFISDTQA

SEQ ID NO: 211176 - protein, 40 aa, Artificial Sequence
  Description of Artificial Sequence: Synthetic polypeptide
DDAEISTTNPVAYEGYGQCQVCSNWGEDHNAEGFNSDTQS

SEQ ID NO: 211177 - protein, 40 aa, Artificial Sequence
  Description of Artificial Sequence: Synthetic polypeptide
DDAEISTTNPVAYEGYGQCAVCSNWGEDHNAENFNSDTQS

SEQ ID NO: 211178 - protein, 40 aa, Artificial Sequence
  Description of Artificial Sequence: Synthetic polypeptide
DEAEISTTNPVAYEHYGQCAVCQNWGEDDNAENFNSDNQS

SEQ ID NO: 211179 - protein, 39 aa, Artificial Sequence
  Description of Artificial Sequence: Synthetic polypeptide
DDAEISTTNPVAYEGYGICICSNWGEDHNIEFFNSDTQS

SEQ ID NO: 211180 - protein, 39 aa, Artificial Sequence
  Description of Artificial Sequence: Synthetic polypeptide
DDAEISTTNPVAYEAYGQCVCQNWGEDHNAEHSNSDNQS

SEQ ID NO: 211181 - protein, 40 aa, Artificial Sequence
  Description of Artificial Sequence: Synthetic polypeptide
DEACISTTNPVATEGYGQCAVCGNWGEADNAENFNSDTQS

SEQ ID NO: 211182 - protein, 40 aa, Artificial Sequence
  Description of Artificial Sequence: Synthetic polypeptide
DDAEISTTNPVAYCQYGQCIVCSNWGEEHNAENFNSDTQS

SEQ ID NO: 211183 - protein, 39 aa, Artificial Sequence
  Description of Artificial Sequence: Synthetic polypeptide
DEACISTTNPVAYEGYGQCVCSNWGEDHNAENFISDTQA

SEQ ID NO: 211184 - protein, 40 aa, Artificial Sequence
  Description of Artificial Sequence: Synthetic polypeptide
DEACISTTNPVATEGYGQCAVCGNWEEDHNAENFNSEFQS

SEQ ID NO: 211185 - protein, 39 aa, Artificial Sequence
  Description of Artificial Sequence: Synthetic polypeptide
DEACISTTNPVAYEGYGQCVCSNWGEDHNIENFISDTQI

SEQ ID NO: 211186 - protein, 38 aa, Artificial Sequence
  Description of Artificial Sequence: Synthetic polypeptide
DQQEIATTNPVAYEQWGHCIIFAGNSGLVDNDSEEDAE

SEQ ID NO: 211187 - protein, 39 aa, Artificial Sequence
  Description of Artificial Sequence: Synthetic polypeptide
DDAEISTTNPVAYEGYGQCVCSNWGEDPNAENFISDPQA

SEQ ID NO: 211188 - protein, 38 aa, Artificial Sequence
  Description of Artificial Sequence: Synthetic polypeptide
SEMEIACTNPCSYEQYGQCVCSWGEDDNQESFGSDTQS

SEQ ID NO: 211189 - protein, 39 aa, Artificial Sequence
  Description of Artificial Sequence: Synthetic polypeptide
DDMCISTTNPVAYEGYGQCVCSDWMEDHNTENFISDTQP

SEQ ID NO: 211190 - protein, 39 aa, Artificial Sequence
  Description of Artificial Sequence: Synthetic polypeptide
AENCISTTNPVAYEGYGQCVCSNWGEDPNAEYFNSDNQS

SEQ ID NO: 211191 - protein, 39 aa, Artificial Sequence
  Description of Artificial Sequence: Synthetic polypeptide
AEACISTTNPCATEGYGQCVCSNSGEAHNAESFNSDNQS

SEQ ID NO: 211192 - protein, 40 aa, Artificial Sequence
  Description of Artificial Sequence: Synthetic polypeptide
DEMEISTVNPVAYEGYGQCAVCGNWGEGHNAENSNSDTQF

SEQ ID NO: 211193 - protein, 38 aa, Artificial Sequence
  Description of Artificial Sequence: Synthetic polypeptide
DEAEIACTNPVATAQWGTHVCAAAAPAGDQEHPMDVAE

SEQ ID NO: 211194 - protein, 40 aa, Artificial Sequence
  Description of Artificial Sequence: Synthetic polypeptide
DEMCISTTNPVATEGYGQCQVCGNWEEDHNAEYFNSEFQS

SEQ ID NO: 211195 - protein, 38 aa, Artificial Sequence
  Description of Artificial Sequence: Synthetic polypeptide
SEACISCTNPVAYEQYGQCYCSNWGEHNAENFNSDTQS

SEQ ID NO: 211196 - protein, 39 aa, Artificial Sequence
  Description of Artificial Sequence: Synthetic polypeptide
AEACISCTNPVAYEQYGQCVCSNWMEDHNAEGFNSDTQA

SEQ ID NO: 211197 - protein, 39 aa, Artificial Sequence
  Description of Artificial Sequence: Synthetic polypeptide
SEACISCTNPVAYEQYGQCVCSMWMEDDNAENFNSDTQS

SEQ ID NO: 211198 - protein, 40 aa, Artificial Sequence
  Description of Artificial Sequence: Synthetic polypeptide
AENCISTTNPVATEGYGICAVCSNWEEDHNAEYFNSENQS

SEQ ID NO: 211199 - protein, 39 aa, Artificial Sequence
  Description of Artificial Sequence: Synthetic polypeptide
AEACISCTNPVAYEQYGQCVCSNWGEDPNAENFNSDTQI

SEQ ID NO: 211200 - protein, 39 aa, Artificial Sequence
  Description of Artificial Sequence: Synthetic polypeptide
SEACISCTNPVATEAYGQCVCSNWGEEHNAENFNSDTQS

SEQ ID NO: 211201 - protein, 40 aa, Artificial Sequence
  Description of Artificial Sequence: Synthetic polypeptide
AENCISTTNPVATEGYGQCAVCSNWGEDHNAENFNSEFQS

SEQ ID NO: 211202 - protein, 39 aa, Artificial Sequence
  Description of Artificial Sequence: Synthetic polypeptide
SEACISCTNPVATEEYGQCVCSNSGEPHNAEYFNSDNQS

SEQ ID NO: 211203 - protein, 39 aa, Artificial Sequence
  Description of Artificial Sequence: Synthetic polypeptide
SENCISCTNPVATEGYGQCVCSNWEEDPNAEYFNSDNQS

SEQ ID NO: 211204 - protein, 39 aa, Artificial Sequence
  Description of Artificial Sequence: Synthetic polypeptide
AEACISCTNPVAYEQYGQCQVCSTWGEHNAENFISDTQS

SEQ ID NO: 211205 - protein, 38 aa, Artificial Sequence
  Description of Artificial Sequence: Synthetic polypeptide
DSNEVASTNPVSYEPYGNVVPAQFATISQMSTGGENEL

SEQ ID NO: 211206 - protein, 40 aa, Artificial Sequence
  Description of Artificial Sequence: Synthetic polypeptide
AENCISTTNPVATEGYGQCQVCSNWEEDHNAENFNSETQS

SEQ ID NO: 211207 - protein, 40 aa, Artificial Sequence
  Description of Artificial Sequence: Synthetic polypeptide
AENEISTTNPVATCGYGQCQVCSNSGEDPNAENFNSQTQL

SEQ ID NO: 211208 - protein, 39 aa, Artificial Sequence
  Description of Artificial Sequence: Synthetic polypeptide
AEACISTTNPVAYEQYGQCYCSNWGEDHNAENFNSDTQS

SEQ ID NO: 211209 - protein, 39 aa, Artificial Sequence
  Description of Artificial Sequence: Synthetic polypeptide
AEACISTTNPVAYEQYGQCYCSNWGEDDNAENFNSDTQS

SEQ ID NO: 211210 - protein, 38 aa, Artificial Sequence
  Description of Artificial Sequence: Synthetic polypeptide
AEACISCTNPVAYEGYGQCVCSNWGEHNAEYFNSDTQP

SEQ ID NO: 211211 - protein, 39 aa, Artificial Sequence
  Description of Artificial Sequence: Synthetic polypeptide
SEACISCTNPVATEGYGQCVCQTWGEDDNAEGFNSDTQI

SEQ ID NO: 211212 - protein, 39 aa, Artificial Sequence
  Description of Artificial Sequence: Synthetic polypeptide
SENAISTTNPVAYCQYGQCVCSNSGEDPNAENFNSQTQL

SEQ ID NO: 211213 - protein, 40 aa, Artificial Sequence
  Description of Artificial Sequence: Synthetic polypeptide
SEACISTTNPVATEYYGQCQCCSNWGADHNTENFISDNQS

SEQ ID NO: 211214 - protein, 39 aa, Artificial Sequence
  Description of Artificial Sequence: Synthetic polypeptide
AEACISCTNPVAYEGYGQCVCSDWGEGHNAENIQSDNQN

SEQ ID NO: 211215 - protein, 40 aa, Artificial Sequence
  Description of Artificial Sequence: Synthetic polypeptide
SEMEISTTNPVATEGYGQCAVCSNSGEDHNAENFPSETQA

SEQ ID NO: 211216 - protein, 39 aa, Artificial Sequence
  Description of Artificial Sequence: Synthetic polypeptide
AENEIRTTNPVAYEGWGQCVTSNWGEDENTEYFISDTAS

SEQ ID NO: 211217 - protein, 38 aa, Artificial Sequence
  Description of Artificial Sequence: Synthetic polypeptide
DSNEVASTNPVSYEPYGNVVYACNATISQMSTGGQNEL

SEQ ID NO: 211218 - protein, 38 aa, Artificial Sequence
  Description of Artificial Sequence: Synthetic polypeptide
SEACISTTNPCAYEQYGQCVCSNSEEHNAENFISDTQS

SEQ ID NO: 211219 - protein, 39 aa, Artificial Sequence
  Description of Artificial Sequence: Synthetic polypeptide
AENEISCTNPVATEGYGQCVCQNWGEDPNAEYFNSDNQS

SEQ ID NO: 211220 - protein, 39 aa, Artificial Sequence
  Description of Artificial Sequence: Synthetic polypeptide
SEACISTTNPVATEGYGQCVCSNWGEDHNAEFFISEPQA

SEQ ID NO: 211221 - protein, 39 aa, Artificial Sequence
  Description of Artificial Sequence: Synthetic polypeptide
SEMEISCTNPVAYEGYGQCSCSNWEELHNAEHFNSDTQA

SEQ ID NO: 211222 - protein, 39 aa, Artificial Sequence
  Description of Artificial Sequence: Synthetic polypeptide
SEACISTTNPVATEGYGQCVCSMWEEDHNIENFISDTQA

SEQ ID NO: 211223 - protein, 39 aa, Artificial Sequence
  Description of Artificial Sequence: Synthetic polypeptide
SEMEISCTNPVAYCGYGQCSCSTWEALHNAEHFNSDTQA

SEQ ID NO: 211224 - protein, 39 aa, Artificial Sequence
  Description of Artificial Sequence: Synthetic polypeptide
DDACIGTVNPVAYEQYGQCVCSNWGEDHNAENFNSDTQA

SEQ ID NO: 211225 - protein, 39 aa, Artificial Sequence
  Description of Artificial Sequence: Synthetic polypeptide
AENCISCTNPVATEGYGQCVCSNWGEPDNTENFISDTQS

SEQ ID NO: 211226 - protein, 39 aa, Artificial Sequence
  Description of Artificial Sequence: Synthetic polypeptide
AEACISTTNPVATEGYGQCVCSNWMEDHNAENFTSETQS

SEQ ID NO: 211227 - protein, 39 aa, Artificial Sequence
  Description of Artificial Sequence: Synthetic polypeptide
AENCISCTNPVATEGYGQCVCSNWGEDPNAENFNSDNQS

SEQ ID NO: 211228 - protein, 39 aa, Artificial Sequence
  Description of Artificial Sequence: Synthetic polypeptide
SEACISTTNPVATEGYGQCVCSMWEEDHNAENFMSDTQS

SEQ ID NO: 211229 - protein, 39 aa, Artificial Sequence
  Description of Artificial Sequence: Synthetic polypeptide
AENEISCTNPVAYEGYGQCVCSNSGEDHNAENFSSDNQA

SEQ ID NO: 211230 - protein, 39 aa, Artificial Sequence
  Description of Artificial Sequence: Synthetic polypeptide
AEACISTTNPVATEGYGQCVCSNWGEDHNAENFISDTQP

SEQ ID NO: 211231 - protein, 39 aa, Artificial Sequence
  Description of Artificial Sequence: Synthetic polypeptide
AEACISTTNPVATEGYGQCVCSNWGEDDNAENFPSEFQG

SEQ ID NO: 211232 - protein, 39 aa, Artificial Sequence
  Description of Artificial Sequence: Synthetic polypeptide
AEACISTTNPVATEGYGQCVCPNWGEDHNAENFQSDTQI

SEQ ID NO: 211233 - protein, 38 aa, Artificial Sequence
  Description of Artificial Sequence: Synthetic polypeptide
AEACISTTNPVATEGYGQCVCGWGEDHNAENFISETQA

SEQ ID NO: 211234 - protein, 40 aa, Artificial Sequence
  Description of Artificial Sequence: Synthetic polypeptide
AEACISTTNPVATEGYGQCQVCQYSGEDDNTENFNSETQA

SEQ ID NO: 211235 - protein, 39 aa, Artificial Sequence
  Description of Artificial Sequence: Synthetic polypeptide
AEACISTTNPVAYEGYGICVCGNWEEDTNAENFNSDTQS

SEQ ID NO: 211236 - protein, 39 aa, Artificial Sequence
  Description of Artificial Sequence: Synthetic polypeptide
SEACISTTNPVATEGYGQCYCSNWGEDHNTENFNSDTQS

SEQ ID NO: 211237 - protein, 40 aa, Artificial Sequence
  Description of Artificial Sequence: Synthetic polypeptide
AEACISTTNPVATEGYGQCQVCGYSGEDHNTEHFNSETQA

SEQ ID NO: 211238 - protein, 39 aa, Artificial Sequence
  Description of Artificial Sequence: Synthetic polypeptide
AEACISTTNPVATEGYGQCICSNWGEDDNAENFNSENQL

SEQ ID NO: 211239 - protein, 40 aa, Artificial Sequence
  Description of Artificial Sequence: Synthetic polypeptide
AEACISTTNPVATEGYGQCAVCSNWGEDDNAENFISDNQS

SEQ ID NO: 211240 - protein, 38 aa, Artificial Sequence
  Description of Artificial Sequence: Synthetic polypeptide
SEMEISTTNPCAYEGYGQCVCQNWGEHNAENFNSETQF

SEQ ID NO: 211241 - protein, 39 aa, Artificial Sequence
  Description of Artificial Sequence: Synthetic polypeptide
DDEAISTTNPVAYEAYGQCVCSNWGEDHNAENFISDTQN

SEQ ID NO: 211242 - protein, 37 aa, Artificial Sequence
  Description of Artificial Sequence: Synthetic polypeptide
DDAELACTNPVSTEGYGCVCQNWMEDNAEYFGSQTQA

SEQ ID NO: 211243 - protein, 39 aa, Artificial Sequence
  Description of Artificial Sequence: Synthetic polypeptide
AEACISTTNPCAYEQYGQCVCQNWMALDNAENFNSDPQS

SEQ ID NO: 211244 - protein, 39 aa, Artificial Sequence
  Description of Artificial Sequence: Synthetic polypeptide
AENEISTTNPCAYEGYGQCVCSNWGEDHNAENFNSDPQS

SEQ ID NO: 211245 - protein, 39 aa, Artificial Sequence
  Description of Artificial Sequence: Synthetic polypeptide
DEMEISTVNPCAYEGYGQCVCSMWGEDPNAENFNSENQQ

SEQ ID NO: 211246 - protein, 39 aa, Artificial Sequence
  Description of Artificial Sequence: Synthetic polypeptide
AEACISTTNPVAYEQYGQCVCSNWGELHNIESFISETQS

SEQ ID NO: 211247 - protein, 40 aa, Artificial Sequence
  Description of Artificial Sequence: Synthetic polypeptide
SENCISTTNPVATEGYGQCAVCSNWEEDHNAENFNSENQS

SEQ ID NO: 211248 - protein, 39 aa, Artificial Sequence
  Description of Artificial Sequence: Synthetic polypeptide
DDEEISTTNPVAYCGYGQCICSNWGEDDNIENFNSDNQG

SEQ ID NO: 211249 - protein, 40 aa, Artificial Sequence
  Description of Artificial Sequence: Synthetic polypeptide
SEACISCTNPVATEQYGQCQVCQYSGEDDNTENFISETQA

SEQ ID NO: 211250 - protein, 40 aa, Artificial Sequence
  Description of Artificial Sequence: Synthetic polypeptide
SEMEISTVNPVAYEGYGQCQVCSTSGEDHNAENINSEPQA

SEQ ID NO: 211251 - protein, 39 aa, Artificial Sequence
  Description of Artificial Sequence: Synthetic polypeptide
AENCISTTNPVAYEQYGQCVCQNWGEPDNTENFISDTQS

SEQ ID NO: 211252 - protein, 39 aa, Artificial Sequence
  Description of Artificial Sequence: Synthetic polypeptide
SEACISCTNPVAYEEYGQCVCSTWGEDDNAEGFNSDTQI

SEQ ID NO: 211253 - protein, 38 aa, Artificial Sequence
  Description of Artificial Sequence: Synthetic polypeptide
AEACISTTNPVATEYWGQCVCGNWGEHNAEYFNSDTQS

SEQ ID NO: 211254 - protein, 39 aa, Artificial Sequence
  Description of Artificial Sequence: Synthetic polypeptide
QEIAEIRRFTNPVCTWQCGYSDTCTCTLLSQNVIFITQY

SEQ ID NO: 211255 - protein, 39 aa, Artificial Sequence
  Description of Artificial Sequence: Synthetic polypeptide
DDEAISTTNPCAYEGYGQCVCSNWGEDDNQENFNSDTQA

SEQ ID NO: 211256 - protein, 39 aa, Artificial Sequence
  Description of Artificial Sequence: Synthetic polypeptide
SEMEISTTNPVAYEGYGQCVCSNWGEDHNAENFISEFQA

SEQ ID NO: 211257 - protein, 39 aa, Artificial Sequence
  Description of Artificial Sequence: Synthetic polypeptide
SEACIACTNPVAYEGYGQCSCSTWEALHNAEHFNSDTQS

SEQ ID NO: 211258 - protein, 39 aa, Artificial Sequence
  Description of Artificial Sequence: Synthetic polypeptide
AEACISTTNPVAYCQYGQCVCSNWGEDDNAEGFNSDTQS

SEQ ID NO: 211259 - protein, 38 aa, Artificial Sequence
  Description of Artificial Sequence: Synthetic polypeptide
DEAEIACTNPVATEQWGCTTIFAGAGAHGPDDSGEGAQ

SEQ ID NO: 211260 - protein, 39 aa, Artificial Sequence
  Description of Artificial Sequence: Synthetic polypeptide
AEACISTTNPVAYEQYGQCVCGNWGEDHNAENFNSDTQI

SEQ ID NO: 211261 - protein, 38 aa, Artificial Sequence
  Description of Artificial Sequence: Synthetic polypeptide
DSSEVASTNPVSYEPYGNVVPAANATISQMSTGGQNFL

SEQ ID NO: 211262 - protein, 37 aa, Artificial Sequence
  Description of Artificial Sequence: Synthetic polypeptide
SEMEIACTNPCSYEQYGQCVCSWGEDNQESFISDTQA

SEQ ID NO: 211263 - protein, 39 aa, Artificial Sequence
  Description of Artificial Sequence: Synthetic polypeptide
AEACISTTNPVAYEEYGQCVCSNWGEGHNAEGFFSDTQS

SEQ ID NO: 211264 - protein, 40 aa, Artificial Sequence
  Description of Artificial Sequence: Synthetic polypeptide
AEACIRTTNPVATEGYGQCQVCGNWGEDHNAENFNSDTQI

SEQ ID NO: 211265 - protein, 39 aa, Artificial Sequence
  Description of Artificial Sequence: Synthetic polypeptide
AEACIGTTNPVAYEQYGQCVCQNWGEDHNTENFISDTQQ

SEQ ID NO: 211266 - protein, 39 aa, Artificial Sequence
  Description of Artificial Sequence: Synthetic polypeptide
AEACISTTNPVAYEQYGQCSCSNWGEDHNAENFISDPQP

SEQ ID NO: 211267 - protein, 39 aa, Artificial Sequence
  Description of Artificial Sequence: Synthetic polypeptide
AEACISTTNPVAYEQYGQCICSNWGEDDNAENFISENQL

SEQ ID NO: 211268 - protein, 38 aa, Artificial Sequence
  Description of Artificial Sequence: Synthetic polypeptide
DEQEIATTNPVAYEMPWGRPPPAGQGPAGQHQDGMEAD

SEQ ID NO: 211269 - protein, 38 aa, Artificial Sequence
  Description of Artificial Sequence: Synthetic polypeptide
AEACISTTNPVAYEGYGQCVCSNWEEHDAENFMSDTQS

SEQ ID NO: 211270 - protein, 39 aa, Artificial Sequence
  Description of Artificial Sequence: Synthetic polypeptide
AEACISTTNPVAYEGYGQCVCSMWEEDHNDENFNSDTQA

SEQ ID NO: 211271 - protein, 39 aa, Artificial Sequence
  Description of Artificial Sequence: Synthetic polypeptide
AENCISTTNPVAYEGYGQCVCSNWGEGDNIEYFNSDNQQ

SEQ ID NO: 211272 - protein, 39 aa, Artificial Sequence
  Description of Artificial Sequence: Synthetic polypeptide
SEAAISTTNPVAYEQYGQCVCSNWEEDHNAENFSSDFQS

SEQ ID NO: 211273 - protein, 40 aa, Artificial Sequence
  Description of Artificial Sequence: Synthetic polypeptide
AEACISTTNPVAYEGYGQCQSCSTWEALHNAEHFNSDTQS

SEQ ID NO: 211274 - protein, 39 aa, Artificial Sequence
  Description of Artificial Sequence: Synthetic polypeptide
DEMCIGCTNPVAYEGYGQCSCGNWEALHNAEHFNSDTQA

SEQ ID NO: 211275 - protein, 38 aa, Artificial Sequence
  Description of Artificial Sequence: Synthetic polypeptide
DSSEVASTNPVSYEPYGINVVAANATISEMSTGGQNRL

SEQ ID NO: 211276 - protein, 39 aa, Artificial Sequence
  Description of Artificial Sequence: Synthetic polypeptide
SEACISTTNPVAYEGYGQCVCSNWGEEDNTENFNSDPQA

SEQ ID NO: 211277 - protein, 39 aa, Artificial Sequence
  Description of Artificial Sequence: Synthetic polypeptide
SEMEISCVNPVAYEQYGQCVCSNSGEDHNAENFNSEPQA

SEQ ID NO: 211278 - protein, 39 aa, Artificial Sequence
  Description of Artificial Sequence: Synthetic polypeptide
SEACISTTNPVAYEGYGQCSCSNWEADHNAEYFNSDNQM

SEQ ID NO: 211279 - protein, 38 aa, Artificial Sequence
  Description of Artificial Sequence: Synthetic polypeptide
AENCISTTNPVAYEGWGCVCSNWGEDHNAENFNSDTQQ

SEQ ID NO: 211280 - protein, 39 aa, Artificial Sequence
  Description of Artificial Sequence: Synthetic polypeptide
AEACISCTNPCATEQYGQCVCSNSEEDHNAENFGSDTQS

SEQ ID NO: 211281 - protein, 38 aa, Artificial Sequence
  Description of Artificial Sequence: Synthetic polypeptide
DEAEIACTNPVATEQWGCIWNAAMNNEEADPSMSEMGV

SEQ ID NO: 211282 - protein, 38 aa, Artificial Sequence
  Description of Artificial Sequence: Synthetic polypeptide
DEAEIACTNPVATEQWGCIWNAAMNWEEADPSMSEDGW

SEQ ID NO: 211283 - protein, 39 aa, Artificial Sequence
  Description of Artificial Sequence: Synthetic polypeptide
SEACISTTNPVAYEGYGQCQVCSNWGEDNAENFNSDNQN

SEQ ID NO: 211284 - protein, 40 aa, Artificial Sequence
  Description of Artificial Sequence: Synthetic polypeptide
DDEEISTTNPVAYCQYGQCIVCQNWGEDHNAENFISDTQS

SEQ ID NO: 211285 - protein, 38 aa, Artificial Sequence
  Description of Artificial Sequence: Synthetic polypeptide
AENCISTTNPVAYEGYGCVCGNWGEDHNAEYFNSDTQI

SEQ ID NO: 211286 - protein, 39 aa, Artificial Sequence
  Description of Artificial Sequence: Synthetic polypeptide
AEACISCTNPVATEGYGQCVCSNWGEDHNAEGFNSDNQM

SEQ ID NO: 211287 - protein, 39 aa, Artificial Sequence
  Description of Artificial Sequence: Synthetic polypeptide
AEACISCTNPVATEGYGQCVCSNWGEAHNAENFNSDTQI

SEQ ID NO: 211288 - protein, 39 aa, Artificial Sequence
  Description of Artificial Sequence: Synthetic polypeptide
SEACISTTNPVAYEGYGQCVCSDWGEDHNTENFSSDTQP

SEQ ID NO: 211289 - protein, 40 aa, Artificial Sequence
  Description of Artificial Sequence: Synthetic polypeptide
SEMEISTTNPVAYEGYGQCQVCSNWEEDHNAEYFNSEFQS

SEQ ID NO: 211290 - protein, 39 aa, Artificial Sequence
  Description of Artificial Sequence: Synthetic polypeptide
SDMCISTTNPVAYEGYGICVCSNWEEDHNAENFMSDNQS

SEQ ID NO: 211291 - protein, 40 aa, Artificial Sequence
  Description of Artificial Sequence: Synthetic polypeptide
AEAEISTTNPVAYEYYGQCQFCSDWGYDHNAENSNSDTQA

SEQ ID NO: 211292 - protein, 39 aa, Artificial Sequence
  Description of Artificial Sequence: Synthetic polypeptide
DEMAIGCTNPVAYEGYGQCVCGNWGEDPNAEYFNSDTQG

SEQ ID NO: 211293 - protein, 39 aa, Artificial Sequence
  Description of Artificial Sequence: Synthetic polypeptide
ADECISTTNPVAYEYYGQCVCSNWGEDHNDENFSSDTQL

SEQ ID NO: 211294 - protein, 40 aa, Artificial Sequence
  Description of Artificial Sequence: Synthetic polypeptide
AEEAISTTNPVSTEFGYGQCSCQNWEEDHNAENFSSETQA

SEQ ID NO: 211295 - protein, 40 aa, Artificial Sequence
  Description of Artificial Sequence: Synthetic polypeptide
ADECISTTNPVAYEQYGQCIVCQNWGYDHNAESFISETQL

SEQ ID NO: 211296 - protein, 39 aa, Artificial Sequence
  Description of Artificial Sequence: Synthetic polypeptide
DEACISCTNPVAYCGYGQCVCSNWGPDHNAEYFNSDTQA

SEQ ID NO: 211297 - protein, 39 aa, Artificial Sequence
  Description of Artificial Sequence: Synthetic polypeptide
SEACISCTNPVAYEGYGQCVCSNWGEDHNAEGFNSDNQI

SEQ ID NO: 211298 - protein, 40 aa, Artificial Sequence
  Description of Artificial Sequence: Synthetic polypeptide
DEACISCTNPVAYEEYGQCQVCSNSGEEDNAENFNSDTQN

SEQ ID NO: 211299 - protein, 39 aa, Artificial Sequence
  Description of Artificial Sequence: Synthetic polypeptide
ADECISTTNPVAYEGYGQCVCSNWGEAHNAENFISETQA

SEQ ID NO: 211300 - protein, 40 aa, Artificial Sequence
  Description of Artificial Sequence: Synthetic polypeptide
ADECISTTNPVAYEQYGQCIVCSNWGEDHNAESFISETQS

SEQ ID NO: 211301 - protein, 39 aa, Artificial Sequence
  Description of Artificial Sequence: Synthetic polypeptide
DENCISCTNPVAYCGYGQCVCSNWGEDDNAEGFNSDTQA

SEQ ID NO: 211302 - protein, 39 aa, Artificial Sequence
  Description of Artificial Sequence: Synthetic polypeptide
AEECISCTNPCAYEGYGQCVCQNWMALDNAENFNSDPQA

SEQ ID NO: 211303 - protein, 42 aa, Artificial Sequence
  Description of Artificial Sequence: Synthetic polypeptide
MEMELESIMPENTVNPVNTLTPESDGSNEQTNMERINAPNRM

SEQ ID NO: 211304 - protein, 40 aa, Artificial Sequence
  Description of Artificial Sequence: Synthetic polypeptide
DEECTISTTNPVAYEGWGQCVCGNWGEDDNAEYFNSDTQL

SEQ ID NO: 211305 - protein, 39 aa, Artificial Sequence
  Description of Artificial Sequence: Synthetic polypeptide
SDMCISTTNPVAYEGYGQCVCSNWGEDPNQENFISENQN

SEQ ID NO: 211306 - protein, 39 aa, Artificial Sequence
  Description of Artificial Sequence: Synthetic polypeptide
AEECIATTNPCAYEGYGQCVCQNSEADHNAENFISDTQS

SEQ ID NO: 211307 - protein, 39 aa, Artificial Sequence
  Description of Artificial Sequence: Synthetic polypeptide
DEACISCTNPVAYCGYGQCVCSNWGEGDNAENFNSETQQ

SEQ ID NO: 211308 - protein, 39 aa, Artificial Sequence
  Description of Artificial Sequence: Synthetic polypeptide
DENCISCTNPVAYEGYGCAVCSNWEEDHNAENFISETQS

SEQ ID NO: 211309 - protein, 39 aa, Artificial Sequence
  Description of Artificial Sequence: Synthetic polypeptide
SENCISTTNPVAYEYYGQCICSTWGADHNAENFMSQPQS

SEQ ID NO: 211310 - protein, 39 aa, Artificial Sequence
  Description of Artificial Sequence: Synthetic polypeptide
DEAAIGCTNPVAYEGYGQCVCGNWGEDDNAENFISDTQG

SEQ ID NO: 211311 - protein, 40 aa, Artificial Sequence
  Description of Artificial Sequence: Synthetic polypeptide
DEACISCTNPVAYEGYGQCQVCSNWGEPDNAEGFNSDTQI

SEQ ID NO: 211312 - protein, 39 aa, Artificial Sequence
  Description of Artificial Sequence: Synthetic polypeptide
VEEEIACTNPVATEQWGCTTIFAGAGMHAGPDDSGEGAQ

SEQ ID NO: 211313 - protein, 39 aa, Artificial Sequence
  Description of Artificial Sequence: Synthetic polypeptide
AEAEISTTNPVSYCQYGQCVCVNWGEDHNAENFNSETQA

SEQ ID NO: 211314 - protein, 39 aa, Artificial Sequence
  Description of Artificial Sequence: Synthetic polypeptide
DEAEISCTNPVAYCGWGQCVCSNWGEGDNAENFNSEFQS

SEQ ID NO: 211315 - protein, 39 aa, Artificial Sequence
  Description of Artificial Sequence: Synthetic polypeptide
AEMEISCTNPVAYEGWGQCYCSNWMEDTNDESFSSDTQS

SEQ ID NO: 211316 - protein, 40 aa, Artificial Sequence
  Description of Artificial Sequence: Synthetic polypeptide
SDMCISTTNPVATEGYGQCIVCSNWGEDDNAESFSSENQL

SEQ ID NO: 211317 - protein, 42 aa, Artificial Sequence
  Description of Artificial Sequence: Synthetic polypeptide
DEEEIATTNPVATTAAWWGTHPVAALATGEGASMNTEGQNNQ

SEQ ID NO: 211318 - protein, 39 aa, Artificial Sequence
  Description of Artificial Sequence: Synthetic polypeptide
DAAEIACTNPVAYEQWGTTASSGDGPAGENPAGNPNEQG

SEQ ID NO: 211319 - protein, 39 aa, Artificial Sequence
  Description of Artificial Sequence: Synthetic polypeptide
SENCISTTNPVAYCGYGQCVCSNWGEDDNAEGFNSDTQS

SEQ ID NO: 211320 - protein, 39 aa, Artificial Sequence
  Description of Artificial Sequence: Synthetic polypeptide
AERCISTTNPVATCAYGQCVCGNWGEDDNAEGFFSQTQS

SEQ ID NO: 211321 - protein, 39 aa, Artificial Sequence
  Description of Artificial Sequence: Synthetic polypeptide
ADECISTTNPVGYEAYGQCVCSNWGEDHNIEHFNSETQM

SEQ ID NO: 211322 - protein, 40 aa, Artificial Sequence
  Description of Artificial Sequence: Synthetic polypeptide
SEACIATTNPVAYEGYGQCQSCSNWEALPNAEYFNSDTQS

SEQ ID NO: 211323 - protein, 40 aa, Artificial Sequence
  Description of Artificial Sequence: Synthetic polypeptide
ADACISTTNPVATEGYGQCIVCSNWGEDHNAESFNSENQL

SEQ ID NO: 211324 - protein, 39 aa, Artificial Sequence
  Description of Artificial Sequence: Synthetic polypeptide
AEMEISCTNPCAYEGYGQCVCSNSEADDNAENFNSDTQS

SEQ ID NO: 211325 - protein, 40 aa, Artificial Sequence
  Description of Artificial Sequence: Synthetic polypeptide
SENCISTTNPVAYEGYGQCAVCSNWEEDHNAENFGSETQS

SEQ ID NO: 211326 - protein, 42 aa, Artificial Sequence
  Description of Artificial Sequence: Synthetic polypeptide
MEEVFILETVGNPVNTCQYVFSCVICTALNLLANWQLMGPTH

SEQ ID NO: 211327 - protein, 38 aa, Artificial Sequence
  Description of Artificial Sequence: Synthetic polypeptide
SEACISCTNPVAYEGWGCVCSNWGEDDNAEGFNSDTQI

SEQ ID NO: 211328 - protein, 39 aa, Artificial Sequence
  Description of Artificial Sequence: Synthetic polypeptide
DEACISTTNPCATEGYGQCICGNWMEDPNAENFISDNQS

SEQ ID NO: 211329 - protein, 39 aa, Artificial Sequence
  Description of Artificial Sequence: Synthetic polypeptide
DEACISCTNPVAYCQWGQCVCSNWVPDHNAEHFNSDTQA

SEQ ID NO: 211330 - protein, 41 aa, Artificial Sequence
  Description of Artificial Sequence: Synthetic polypeptide
YEEEMRATEENNVVQESNLYGASNMSGEDRNIQGQGENEQG

SEQ ID NO: 211331 - protein, 39 aa, Artificial Sequence
  Description of Artificial Sequence: Synthetic polypeptide
ADACISCTNPVAYEQYGQCVCSNWGEDHNAEGFNSDNQI

SEQ ID NO: 211332 - protein, 39 aa, Artificial Sequence
  Description of Artificial Sequence: Synthetic polypeptide
DEACISTTNPCAYEGYGQCVCSNSEEDDNAENFISDTQS

SEQ ID NO: 211333 - protein, 39 aa, Artificial Sequence
  Description of Artificial Sequence: Synthetic polypeptide
AEMEISCTNPCAYEGYGQCVCQTWGALHNAENFISDPQS

SEQ ID NO: 211334 - protein, 40 aa, Artificial Sequence
  Description of Artificial Sequence: Synthetic polypeptide
SDMCISTTNPVAYEQYGQCAVCSMWGEDHNTEHFGSDTQN

SEQ ID NO: 211335 - protein, 39 aa, Artificial Sequence
  Description of Artificial Sequence: Synthetic polypeptide
DEACISTTNPEATEGWGQCVCYNWEEDHNAEYFNSDNQP

SEQ ID NO: 211336 - protein, 39 aa, Artificial Sequence
  Description of Artificial Sequence: Synthetic polypeptide
DEACISTTNPEAYEQWGQCVCYNWEEDHNAEYFISDNQP

SEQ ID NO: 211337 - protein, 40 aa, Artificial Sequence
  Description of Artificial Sequence: Synthetic polypeptide
DEACISTTNPVATCGWGQCAVCSDWGEDDNAENFNSQTQP

SEQ ID NO: 211338 - protein, 39 aa, Artificial Sequence
  Description of Artificial Sequence: Synthetic polypeptide
DEACISTTNPVATCGWGQCVCYNWGEDDNAENFMSDTQL

SEQ ID NO: 211339 - protein, 39 aa, Artificial Sequence
  Description of Artificial Sequence: Synthetic polypeptide
ADACISTTNPVATCGYGQCVCSNWGPDDNIEYFNSDTQA

SEQ ID NO: 211340 - protein, 39 aa, Artificial Sequence
  Description of Artificial Sequence: Synthetic polypeptide
AEMEISCTNPCAYEGYGQCVCQNWGALDNAENFISDPQA

SEQ ID NO: 211341 - protein, 39 aa, Artificial Sequence
  Description of Artificial Sequence: Synthetic polypeptide
AEACISTTNPVAYCGYGQCVCSNWGPDDNAEYFNSDTQA

SEQ ID NO: 211342 - protein, 39 aa, Artificial Sequence
  Description of Artificial Sequence: Synthetic polypeptide
ADACISTTNPVATEGYGQCVCSMWEEDHNQENFMSDTQS

SEQ ID NO: 211343 - protein, 38 aa, Artificial Sequence
  Description of Artificial Sequence: Synthetic polypeptide
DEAEIATTNPCAYAPWGATTAALATDGPANPKMNPQNA

SEQ ID NO: 211344 - protein, 39 aa, Artificial Sequence
  Description of Artificial Sequence: Synthetic polypeptide
SDMCISCTNPVAYEGYGICVCSNWVEDDNTENFSSDNQA

SEQ ID NO: 211345 - protein, 40 aa, Artificial Sequence
  Description of Artificial Sequence: Synthetic polypeptide
AEAEISTTNPVAYEHYGQCAVCSNWGEDHNAENFSSDTQS

SEQ ID NO: 211346 - protein, 40 aa, Artificial Sequence
  Description of Artificial Sequence: Synthetic polypeptide
DDAEISTTNPVAYCGYGICIVCSNWGEDHNAEYFNSDTQS

SEQ ID NO: 211347 - protein, 38 aa, Artificial Sequence
  Description of Artificial Sequence: Synthetic polypeptide
SDMAISTVNPVAYEGYGQCVCSNWGEDNTENFSSDPQA

SEQ ID NO: 211348 - protein, 40 aa, Artificial Sequence
  Description of Artificial Sequence: Synthetic polypeptide
SEACISCTNPVATEQWGQCQVCSNWGEDDNAENSNSETQA

SEQ ID NO: 211349 - protein, 40 aa, Artificial Sequence
  Description of Artificial Sequence: Synthetic polypeptide
DEACIGTTNPVAYEGYGQCQFCSNWGEDDNAESFNSDTQS

SEQ ID NO: 211350 - protein, 39 aa, Artificial Sequence
  Description of Artificial Sequence: Synthetic polypeptide
DEMCLSTTNPVAYEGWGQCSCSNWGEAHNAEFFNSVNQP

SEQ ID NO: 211351 - protein, 42 aa, Artificial Sequence
  Description of Artificial Sequence: Synthetic polypeptide
DENEIATTNPTCMLYYFEDPYGSTVAVNSDGGQGGMNPNGEM

SEQ ID NO: 211352 - protein, 40 aa, Artificial Sequence
  Description of Artificial Sequence: Synthetic polypeptide
DDMCISTTNPVAYEGYGQCQVCSNWGYDHNAESFISENQL

SEQ ID NO: 211353 - protein, 40 aa, Artificial Sequence
  Description of Artificial Sequence: Synthetic polypeptide
DDMCISTTNPVAYEGYGQCIVCSNWGYDHNAESFNSETQA

SEQ ID NO: 211354 - protein, 40 aa, Artificial Sequence
  Description of Artificial Sequence: Synthetic polypeptide
ADEAISTTNPVAYEGQYGQCVCGNWGEPHNAENFNSDTQA

SEQ ID NO: 211355 - protein, 39 aa, Artificial Sequence
  Description of Artificial Sequence: Synthetic polypeptide
AEACISCTNPCAYEQYGQCVCQNWGALHNAENFGSDTQS

SEQ ID NO: 211356 - protein, 39 aa, Artificial Sequence
  Description of Artificial Sequence: Synthetic polypeptide
DDMEISCTNPVAYEGYGQCVCENWGEDHNAEYFFSDTQQ

SEQ ID NO: 211357 - protein, 38 aa, Artificial Sequence
  Description of Artificial Sequence: Synthetic polypeptide
AEACISCTNPVAYCGYGCVCSNWGEGDNAENFSSENQQ

SEQ ID NO: 211358 - protein, 40 aa, Artificial Sequence
  Description of Artificial Sequence: Synthetic polypeptide
NEVGIRTTTNPFEYTDFIYGYSFEGLYTMVWQSVGDGTMR

SEQ ID NO: 211359 - protein, 39 aa, Artificial Sequence
  Description of Artificial Sequence: Synthetic polypeptide
AEACISCTNPVAYCQYGQCVCSNWGEGHNAESFLSDTQN

SEQ ID NO: 211360 - protein, 40 aa, Artificial Sequence
  Description of Artificial Sequence: Synthetic polypeptide
ADECIATTNPVAYEGYGQCIVCSNWGYDHNAESFNSETQS

SEQ ID NO: 211361 - protein, 39 aa, Artificial Sequence
  Description of Artificial Sequence: Synthetic polypeptide
EANEIATTNCTCLYYEPYGSTVAVNSDGGQGGMNPADQA

SEQ ID NO: 211362 - protein, 39 aa, Artificial Sequence
  Description of Artificial Sequence: Synthetic polypeptide
ADECIGCTNPVAYEQYGQCVCQNWGEDHNTEYFFSDTQQ

SEQ ID NO: 211363 - protein, 40 aa, Artificial Sequence
  Description of Artificial Sequence: Synthetic polypeptide
DEACISTTNPVAYEAYGQCAVCSNWGEDHNAENFSSDTQS

SEQ ID NO: 211364 - protein, 39 aa, Artificial Sequence
  Description of Artificial Sequence: Synthetic polypeptide
DEACISTTNPVAYCGYGQCVCQNWGPDDDAEYFNSDTQA

SEQ ID NO: 211365 - protein, 39 aa, Artificial Sequence
  Description of Artificial Sequence: Synthetic polypeptide
AEACISCTNPVAYEGYGQCVCSNWGEDDNAEGFNSDTQI

SEQ ID NO: 211366 - protein, 40 aa, Artificial Sequence
  Description of Artificial Sequence: Synthetic polypeptide
DEACISTTNPVAYCAYGQCQVCSNWGPDHNAEYFNSDTQA

SEQ ID NO: 211367 - protein, 40 aa, Artificial Sequence
  Description of Artificial Sequence: Synthetic polypeptide
DDMEISTTNPVAYCAYGQCIVCSNWGEDHNAEHFNSDTQS

SEQ ID NO: 211368 - protein, 39 aa, Artificial Sequence
  Description of Artificial Sequence: Synthetic polypeptide
AEACISCTNPVAYEGYGQCVCSNWMEPHNAEGFNSDTQI

SEQ ID NO: 211369 - protein, 39 aa, Artificial Sequence
  Description of Artificial Sequence: Synthetic polypeptide
AEAAIGCTNPVATEGYGICVCGNWGEDHNAENFISDTQG

SEQ ID NO: 211370 - protein, 39 aa, Artificial Sequence
  Description of Artificial Sequence: Synthetic polypeptide
AEMCISCTNPVAYEQYGQCVCPNWGYDPNAEYFNSDNQF

SEQ ID NO: 211371 - protein, 39 aa, Artificial Sequence
  Description of Artificial Sequence: Synthetic polypeptide
AEMCISCTNPVAYEGYGQCVCSNWGPAHNAEGFNSDNQL

SEQ ID NO: 211372 - protein, 39 aa, Artificial Sequence
  Description of Artificial Sequence: Synthetic polypeptide
AEMCISCTNPVAYEGYGQCVCSNWEEDTNAEAFMSDTQS

SEQ ID NO: 211373 - protein, 39 aa, Artificial Sequence
  Description of Artificial Sequence: Synthetic polypeptide
AEACISCTNPVAYEGYGICVCSNWEEDTNAEHFISDTQS

SEQ ID NO: 211374 - protein, 40 aa, Artificial Sequence
  Description of Artificial Sequence: Synthetic polypeptide
AEAAIRCTNPVSTEQYGQCASCQNWPEDHNAEYFSSDTQA

SEQ ID NO: 211375 - protein, 39 aa, Artificial Sequence
  Description of Artificial Sequence: Synthetic polypeptide
DEHEIATTNPCAYAPWGHATTSANATDGPAEPKGSPQNH

SEQ ID NO: 211376 - protein, 39 aa, Artificial Sequence
  Description of Artificial Sequence: Synthetic polypeptide
DEHEIATTNPCAYAPWGHATSSANATDGPAEPKISPQNA

SEQ ID NO: 211377 - protein, 40 aa, Artificial Sequence
  Description of Artificial Sequence: Synthetic polypeptide
DDMCISTTNPVAYEQYGQCIVCGNWGYDHNAESFSSETQL

SEQ ID NO: 211378 - protein, 38 aa, Artificial Sequence
  Description of Artificial Sequence: Synthetic polypeptide
AEACIGCTNPVAYEGYGCVCQNWGEDHNTEHFFSDTQQ

SEQ ID NO: 211379 - protein, 39 aa, Artificial Sequence
  Description of Artificial Sequence: Synthetic polypeptide
AEACIGCTNPVAYEGYGQCSCSNWEALHNAEHFNSDTQA

SEQ ID NO: 211380 - protein, 40 aa, Artificial Sequence
  Description of Artificial Sequence: Synthetic polypeptide
AEACIGTTNPVAYEGYGICQFCSVWGEDDNAESFNSDTQS

SEQ ID NO: 211381 - protein, 39 aa, Artificial Sequence
  Description of Artificial Sequence: Synthetic polypeptide
AEACIGTTNPVAYEGYGQCVCQNWGEDHNTEYFFSDTQQ

SEQ ID NO: 211382 - protein, 39 aa, Artificial Sequence
  Description of Artificial Sequence: Synthetic polypeptide
AEAAISTTNPVAYEGYGQCVCGNWGEDHNDEHFGSDTQA

SEQ ID NO: 211383 - protein, 38 aa, Artificial Sequence
  Description of Artificial Sequence: Synthetic polypeptide
DENEIATTNPCAYAPWGATTAALATDGPAEAKQNPQNA

SEQ ID NO: 211384 - protein, 40 aa, Artificial Sequence
  Description of Artificial Sequence: Synthetic polypeptide
AEACIGTTNPVAYEQYGQCQFCSNWGEDDNAESFNSDTQA

SEQ ID NO: 211385 - protein, 39 aa, Artificial Sequence
  Description of Artificial Sequence: Synthetic polypeptide
ADAEISTTNPVAYEHYGQCVCSMWGEDHNAEYFISQTQS

SEQ ID NO: 211386 - protein, 40 aa, Artificial Sequence
  Description of Artificial Sequence: Synthetic polypeptide
SEAAISTTNPVSTEFQYGQCSCQNWPEDHNAENFSSETQA

SEQ ID NO: 211387 - protein, 39 aa, Artificial Sequence
  Description of Artificial Sequence: Synthetic polypeptide
AEMCISTTNPVAYEGYGQCVCSNWGEAHNAENFISETQS

SEQ ID NO: 211388 - protein, 38 aa, Artificial Sequence
  Description of Artificial Sequence: Synthetic polypeptide
DENEIATTNPCAYAPWGHATTSANATDGPAEPKGPQKD

SEQ ID NO: 211389 - protein, 39 aa, Artificial Sequence
  Description of Artificial Sequence: Synthetic polypeptide
DENEIATTNPCAYAPWGHATTSANATDGPAEPKGSPENM

SEQ ID NO: 211390 - protein, 38 aa, Artificial Sequence
  Description of Artificial Sequence: Synthetic polypeptide
ETTEIATTNPIATECWGATYYANENDKQLHEKTGKGMS

SEQ ID NO: 211391 - protein, 40 aa, Artificial Sequence
  Description of Artificial Sequence: Synthetic polypeptide
DEACISTTNPVAYEGYGQCAVCSNWEEDDNAENFFSETQA

SEQ ID NO: 211392 - protein, 39 aa, Artificial Sequence
  Description of Artificial Sequence: Synthetic polypeptide
AEMCISTTNPVAYEGYGQCVCPNWGYDPNIEYFNSDTQF

SEQ ID NO: 211393 - protein, 40 aa, Artificial Sequence
  Description of Artificial Sequence: Synthetic polypeptide
AEMCISTTNPVAYEGYGQCQVCSNWGEDPNTEYFLSDNQA

SEQ ID NO: 211394 - protein, 40 aa, Artificial Sequence
  Description of Artificial Sequence: Synthetic polypeptide
AEMCISTTNPVAYEGYGQCAVCSNWGEPHNAENFGSEFQS

SEQ ID NO: 211395 - protein, 40 aa, Artificial Sequence
  Description of Artificial Sequence: Synthetic polypeptide
AEACIRTTNPVAYEGYGQCAVCSNWGEPHNAENFISEFQS

SEQ ID NO: 211396 - protein, 39 aa, Artificial Sequence
  Description of Artificial Sequence: Synthetic polypeptide
AEMCISTTNPVAYEGYGCAVCSNWEEDHNAENFISETQS

SEQ ID NO: 211397 - protein, 39 aa, Artificial Sequence
  Description of Artificial Sequence: Synthetic polypeptide
CEACIGTTNPCATEGYGQCVCYNWGEDDNAENFISDTQS

SEQ ID NO: 211398 - protein, 39 aa, Artificial Sequence
  Description of Artificial Sequence: Synthetic polypeptide
CEDEIATTNPVAYEMPWGRPPPAGQGPALTDHQDGMEAV

SEQ ID NO: 211399 - protein, 40 aa, Artificial Sequence
  Description of Artificial Sequence: Synthetic polypeptide
DDEEISTTNPVAYCGYGQCIVCGNWGEDHNAEYFNSDTQS

SEQ ID NO: 211400 - protein, 40 aa, Artificial Sequence
  Description of Artificial Sequence: Synthetic polypeptide
DEAEIGCTNPVAYEGYGQCQVCSNWGEDHNAENFISDTQT

SEQ ID NO: 211401 - protein, 40 aa, Artificial Sequence
  Description of Artificial Sequence: Synthetic polypeptide
SDMCISTTNPVAYEQYGQCIVCSNWGYDHNAESFNSETQS

SEQ ID NO: 211402 - protein, 38 aa, Artificial Sequence
  Description of Artificial Sequence: Synthetic polypeptide
AEECISTTNPEAYEGWGCVCYNWEEDHNAEYFNSDNQP

SEQ ID NO: 211403 - protein, 38 aa, Artificial Sequence
  Description of Artificial Sequence: Synthetic polypeptide
DTAEIACTNPVATEQWGCIWNAAMNNEEAKPSMSEMGW

SEQ ID NO: 211404 - protein, 39 aa, Artificial Sequence
  Description of Artificial Sequence: Synthetic polypeptide
AEMAIGTTNPVAYEGYGQCVCGNWGEADNAENFISDNQG

SEQ ID NO: 211405 - protein, 39 aa, Artificial Sequence
  Description of Artificial Sequence: Synthetic polypeptide
AEACISTTNPCAYEGYGQCVCQTWGALDNAEYFNSDPQA

SEQ ID NO: 211406 - protein, 41 aa, Artificial Sequence
  Description of Artificial Sequence: Synthetic polypeptide
DEEEVLNMVGPNEVVIEIHQGPEGSIVVSITAFEQDIKNRA

SEQ ID NO: 211407 - protein, 39 aa, Artificial Sequence
  Description of Artificial Sequence: Synthetic polypeptide
ADACIRTTNPVAYEHYGQCVCSNWGEDHNAENFISDTQN

SEQ ID NO: 211408 - protein, 40 aa, Artificial Sequence
  Description of Artificial Sequence: Synthetic polypeptide
DEMCIRTVNPVAYEGYGQCAVCGNWGEDHNAENSNSDTQF

SEQ ID NO: 211409 - protein, 39 aa, Artificial Sequence
  Description of Artificial Sequence: Synthetic polypeptide
DERCISCTNPVAYEQWGQCVCGNWGEEDNAEGFISDTQA

SEQ ID NO: 211410 - protein, 39 aa, Artificial Sequence
  Description of Artificial Sequence: Synthetic polypeptide
ADECISTTNCVAYEGYGCAVCSNWGEDDNIEGFNSDTQI

SEQ ID NO: 211411 - protein, 40 aa, Artificial Sequence
  Description of Artificial Sequence: Synthetic polypeptide
AEACISTTNPVATEGYGQCAVCSNWEEDHNAEYFFSETQA

SEQ ID NO: 211412 - protein, 40 aa, Artificial Sequence
  Description of Artificial Sequence: Synthetic polypeptide
MEQVDGEITIVNHIYNRTEDQFYDKVEMTAAQSERGNPRI

SEQ ID NO: 211413 - protein, 40 aa, Artificial Sequence
  Description of Artificial Sequence: Synthetic polypeptide
AEACISTTNPVATEGYGQCQVCSNWGEDHNAEGFISDTQS

SEQ ID NO: 211414 - protein, 40 aa, Artificial Sequence
  Description of Artificial Sequence: Synthetic polypeptide
AEMAIRCTNPVSTEQYGQCASCQNWGEDDNAEYFISDTQA

SEQ ID NO: 211415 - protein, 40 aa, Artificial Sequence
  Description of Artificial Sequence: Synthetic polypeptide
DEEELMGTTNVVCCATPCQNWGNKACEPAEVNEQMGEEQQ

SEQ ID NO: 211416 - protein, 40 aa, Artificial Sequence
  Description of Artificial Sequence: Synthetic polypeptide
CDAEIATTNPVATEQWGQCQTCGNWGADNNIENFNSDTQA

SEQ ID NO: 211417 - protein, 39 aa, Artificial Sequence
  Description of Artificial Sequence: Synthetic polypeptide
DDMAISTTNPVAYEQYGQCICSNWGEDHNAENFSSDTQG

SEQ ID NO: 211418 - protein, 40 aa, Artificial Sequence
  Description of Artificial Sequence: Synthetic polypeptide
MEPEVPTMTTMTNCNRAQEMDIEFGFVTDTANMSRIGDNR

SEQ ID NO: 211419 - protein, 40 aa, Artificial Sequence
  Description of Artificial Sequence: Synthetic polypeptide
DEAEISCTNPVAYEGYGQCQVCSNWGEDHNQENFISDTQA

SEQ ID NO: 211420 - protein, 40 aa, Artificial Sequence
  Description of Artificial Sequence: Synthetic polypeptide
DEAEISCTNPVAYEGYGQCQVCSNWGEDHNAEGFISDTQS

SEQ ID NO: 211421 - protein, 39 aa, Artificial Sequence
  Description of Artificial Sequence: Synthetic polypeptide
DDEAIGCTNPVAYEGYGQCVCGTWGEDDNAENFISDTQG

SEQ ID NO: 211422 - protein, 40 aa, Artificial Sequence
  Description of Artificial Sequence: Synthetic polypeptide
SDMCISTTNPVAYEQYGQCQVCSNWGEDPNTEYFLSDNQA

SEQ ID NO: 211423 - protein, 40 aa, Artificial Sequence
  Description of Artificial Sequence: Synthetic polypeptide
AEEEISTVNPVAYEGYGQCAVCGNWGEDDNAENSISDTQF

SEQ ID NO: 211424 - protein, 39 aa, Artificial Sequence
  Description of Artificial Sequence: Synthetic polypeptide
DEMEISTTNPVSYCGYGQCVCVNWGEDHNAENFNSETQA

SEQ ID NO: 211425 - protein, 39 aa, Artificial Sequence
  Description of Artificial Sequence: Synthetic polypeptide
ADECISTTNPVAYEGYGQCVCENWMEDHNAEYFFSDTQQ

SEQ ID NO: 211426 - protein, 39 aa, Artificial Sequence
  Description of Artificial Sequence: Synthetic polypeptide
DDMCIACTNPVAYEGYGQCSCSNWEALDNAEYFNSDTQA

SEQ ID NO: 211427 - protein, 39 aa, Artificial Sequence
  Description of Artificial Sequence: Synthetic polypeptide
AEMAIRCTNPVSYEQYGCASCQNWGEDDNAENFISDTQS

SEQ ID NO: 211428 - protein, 40 aa, Artificial Sequence
  Description of Artificial Sequence: Synthetic polypeptide
AEECISTTNPCAYEGYGQCQVCQNWGALDNAENFNSDPQA

SEQ ID NO: 211429 - protein, 39 aa, Artificial Sequence
  Description of Artificial Sequence: Synthetic polypeptide
AEACISTTNPCAYEGYGICVCSNSEADHNAENFNSDTQA

SEQ ID NO: 211430 - protein, 39 aa, Artificial Sequence
  Description of Artificial Sequence: Synthetic polypeptide
ADYCISTTNPVAYEGYGQCVCSMWGEDDNAEYFPSDNQS

SEQ ID NO: 211431 - protein, 40 aa, Artificial Sequence
  Description of Artificial Sequence: Synthetic polypeptide
DDAAISTTNPVAYEGQYGQCVCGNWGEPHNAENFNSDTQS

SEQ ID NO: 211432 - protein, 39 aa, Artificial Sequence
  Description of Artificial Sequence: Synthetic polypeptide
NEECISTTNPVAYCGYGQCICSNWGEDHNTEGFNSDNAS

SEQ ID NO: 211433 - protein, 39 aa, Artificial Sequence
  Description of Artificial Sequence: Synthetic polypeptide
DEMCISTTNPCAYEGYGQCVCGNSEADHNAENFSSDTQA

SEQ ID NO: 211434 - protein, 39 aa, Artificial Sequence
  Description of Artificial Sequence: Synthetic polypeptide
AEMCIATTNPVAYEGWGQCSCSNWEALHNAEHFNSDNQS

SEQ ID NO: 211435 - protein, 39 aa, Artificial Sequence
  Description of Artificial Sequence: Synthetic polypeptide
DDMEISTTNPVSYCQYGQCVCVNWGEDHNAENFISETQA

SEQ ID NO: 211436 - protein, 39 aa, Artificial Sequence
  Description of Artificial Sequence: Synthetic polypeptide
DDNAISCTNPVATEGYGQCVCSNWGEDDNTEHFISDTQM

SEQ ID NO: 211437 - protein, 40 aa, Artificial Sequence
  Description of Artificial Sequence: Synthetic polypeptide
DEAEISCTNPVAYEHYGQCQVCSNWGEDHNAENFSSDTQS

SEQ ID NO: 211438 - protein, 39 aa, Artificial Sequence
  Description of Artificial Sequence: Synthetic polypeptide
DEMCISTTNPCAYEQWGCQVCGNWGEDHNDESFNSDTQA

SEQ ID NO: 211439 - protein, 39 aa, Artificial Sequence
  Description of Artificial Sequence: Synthetic polypeptide
AEMAISTVNPVAYEGYGQCVCSNWGEDDNTENFSSDPQA

SEQ ID NO: 211440 - protein, 39 aa, Artificial Sequence
  Description of Artificial Sequence: Synthetic polypeptide
AEACISTTNPCATEGYGQCVCGNSEADHNAENFISDTQA

SEQ ID NO: 211441 - protein, 39 aa, Artificial Sequence
  Description of Artificial Sequence: Synthetic polypeptide
AEMAISCVNPVATEGYGQCVCSNWGEDDNTENFISDPQA

SEQ ID NO: 211442 - protein, 38 aa, Artificial Sequence
  Description of Artificial Sequence: Synthetic polypeptide
AEMAISCTNPVSYEQYGCASCQNWGEDNAEYFISDTQA

SEQ ID NO: 211443 - protein, 39 aa, Artificial Sequence
  Description of Artificial Sequence: Synthetic polypeptide
DEMCISTTNPCAYEQWGQCVCGNWGEDHNDESFISDTQA

SEQ ID NO: 211444 - protein, 40 aa, Artificial Sequence
  Description of Artificial Sequence: Synthetic polypeptide
CEAEISCTNPVAYEQWGQCICCSMSGEDDNAENFNSDTQS

SEQ ID NO: 211445 - protein, 39 aa, Artificial Sequence
  Description of Artificial Sequence: Synthetic polypeptide
AEACISTTNPCATEGYGQCVCQNWGADHNAEHFNSDPQA

SEQ ID NO: 211446 - protein, 39 aa, Artificial Sequence
  Description of Artificial Sequence: Synthetic polypeptide
NDMAISTTNPLAYEQYGQCVCSNSGEDPNAEHFNSDTQS

SEQ ID NO: 211447 - protein, 39 aa, Artificial Sequence
  Description of Artificial Sequence: Synthetic polypeptide
AEMAISCTNPVSTEQYGQCASCQNWPEDNAENFNSDTQS

SEQ ID NO: 211448 - protein, 38 aa, Artificial Sequence
  Description of Artificial Sequence: Synthetic polypeptide
AEMAISCTNPVSTEAYGCASCQNWGEDNAEYFNSDTQA

SEQ ID NO: 211449 - protein, 40 aa, Artificial Sequence
  Description of Artificial Sequence: Synthetic polypeptide
DDMCIRCTNPVAYEGYGQCIVCSNWGYDDNAESFNSENQL

SEQ ID NO: 211450 - protein, 39 aa, Artificial Sequence
  Description of Artificial Sequence: Synthetic polypeptide
NDAEIATTNPVAYEGYGQCQVCQNWGEHNIEYFNSETQA

SEQ ID NO: 211451 - protein, 40 aa, Artificial Sequence
  Description of Artificial Sequence: Synthetic polypeptide
DDMCIGTTNPVAYEGYGQCIVCSNWGYDHNAESFISENQA

SEQ ID NO: 211452 - protein, 39 aa, Artificial Sequence
  Description of Artificial Sequence: Synthetic polypeptide
AEMAISCTNPVAYEQYGQCVCSNWGEDHNIEGFISDTQN

SEQ ID NO: 211453 - protein, 39 aa, Artificial Sequence
  Description of Artificial Sequence: Synthetic polypeptide
AEMCISCTNPVAYEGYGQCSCSNWEALDNAEYFNSDTQA

SEQ ID NO: 211454 - protein, 38 aa, Artificial Sequence
  Description of Artificial Sequence: Synthetic polypeptide
DEEEMRGTQQDTADQMQQNPTLSDLSNEMQERTGTMEV

SEQ ID NO: 211455 - protein, 40 aa, Artificial Sequence
  Description of Artificial Sequence: Synthetic polypeptide
DEACISCTNPVATEGYGQCQVCSNWGEDHNAEGFISDTQA

SEQ ID NO: 211456 - protein, 39 aa, Artificial Sequence
  Description of Artificial Sequence: Synthetic polypeptide
AEACISTTNPVAYEGYGQCVCQNWEEDTNAENFMSDTQS

SEQ ID NO: 211457 - protein, 40 aa, Artificial Sequence
  Description of Artificial Sequence: Synthetic polypeptide
ADMCIATTNPVAYEQYGQCIVCSNWGYDHNAESFNSQTQL

SEQ ID NO: 211458 - protein, 39 aa, Artificial Sequence
  Description of Artificial Sequence: Synthetic polypeptide
SEMAISTVNPVAYEGYGQCVCSNWGEDDNTEYFNSDPQA

SEQ ID NO: 211459 - protein, 39 aa, Artificial Sequence
  Description of Artificial Sequence: Synthetic polypeptide
SEMAISTVNPVAYEGYGQCVCSNWMEDDNTENFISDPQS

SEQ ID NO: 211460 - protein, 40 aa, Artificial Sequence
  Description of Artificial Sequence: Synthetic polypeptide
SEAEISTTNPVAYEGWGQCQVCSNWGEDDNAENSNSETQA

SEQ ID NO: 211461 - protein, 39 aa, Artificial Sequence
  Description of Artificial Sequence: Synthetic polypeptide
DEMCIRCTNPCAYEQWGQCVCGNWGEDHNDESFNSDTQA

SEQ ID NO: 211462 - protein, 39 aa, Artificial Sequence
  Description of Artificial Sequence: Synthetic polypeptide
DEECISTTNPVAYCGYGQCFCPNWGEWHNAENSNSDTQS

SEQ ID NO: 211463 - protein, 39 aa, Artificial Sequence
  Description of Artificial Sequence: Synthetic polypeptide
SEMCIATTNPCAYEGYGQCVCSNSEADHNAENFNSDTQA

SEQ ID NO: 211464 - protein, 39 aa, Artificial Sequence
  Description of Artificial Sequence: Synthetic polypeptide
ADMAISTTNPVATEQYGQCICSNWGEDHNAENFISDTQG

SEQ ID NO: 211465 - protein, 39 aa, Artificial Sequence
  Description of Artificial Sequence: Synthetic polypeptide
SEAEISTTNPVAYCGWGQCVCSNWVPDHNAEHFNSDTQA

SEQ ID NO: 211466 - protein, 40 aa, Artificial Sequence
  Description of Artificial Sequence: Synthetic polypeptide
SEMCIATTNPVAYEQWGQCQVCSNWGEDHNAENSNSETQS

SEQ ID NO: 211467 - protein, 39 aa, Artificial Sequence
  Description of Artificial Sequence: Synthetic polypeptide
SEMCIGCTNPVAYEQYGQCVCQNWGEDHNTEHFFSDTQQ

SEQ ID NO: 211468 - protein, 40 aa, Artificial Sequence
  Description of Artificial Sequence: Synthetic polypeptide
DENCISTTNPVAYEGYGQCQVCSNWEEDHNAENFISETQS

SEQ ID NO: 211469 - protein, 39 aa, Artificial Sequence
  Description of Artificial Sequence: Synthetic polypeptide
ADAEISCTNPVAYEGYGQCSCSNWEALDNIEYFNSDTQA

SEQ ID NO: 211470 - protein, 39 aa, Artificial Sequence
  Description of Artificial Sequence: Synthetic polypeptide
SDACISCTNPVATEAYGQCVCSNWGEDDNAEGFNSDTQI

SEQ ID NO: 211471 - protein, 40 aa, Artificial Sequence
  Description of Artificial Sequence: Synthetic polypeptide
SDACIRTTNPVAYEGYGQCIVCSNWGYDHNAESFNSETQA

SEQ ID NO: 211472 - protein, 40 aa, Artificial Sequence
  Description of Artificial Sequence: Synthetic polypeptide
AEEEISCTNPVAYCGYGQCQVCGNSGEEDNAEGFGSDTQS

SEQ ID NO: 211473 - protein, 40 aa, Artificial Sequence
  Description of Artificial Sequence: Synthetic polypeptide
SEMCISTTNPVATEQWGQCQVCGNWGEDHNAENSISETQS

SEQ ID NO: 211474 - protein, 39 aa, Artificial Sequence
  Description of Artificial Sequence: Synthetic polypeptide
AEEEISCTNPVAYEGWGQCVCGMWGEDDNAEAFISDNQM

SEQ ID NO: 211475 - protein, 39 aa, Artificial Sequence
  Description of Artificial Sequence: Synthetic polypeptide
SEAEISTTNPVATCGWGQCVCYNWGEDHNAENFMSDTQL

SEQ ID NO: 211476 - protein, 40 aa, Artificial Sequence
  Description of Artificial Sequence: Synthetic polypeptide
SDACIATTNPVAYEQYGQCIVCSNWGYDHNAESFNSETQL

SEQ ID NO: 211477 - protein, 40 aa, Artificial Sequence
  Description of Artificial Sequence: Synthetic polypeptide
AEEEISCTNPVAYEGYGQCQVCSNWGEDHFAENFISDTQS

SEQ ID NO: 211478 - protein, 39 aa, Artificial Sequence
  Description of Artificial Sequence: Synthetic polypeptide
SDACIACTNPVATCAYGQCVCSTSGYDHNAEYINSDTQN

SEQ ID NO: 211479 - protein, 39 aa, Artificial Sequence
  Description of Artificial Sequence: Synthetic polypeptide
SEAEISCTNPVAYEGYGQCVCENWMEDHNAEYFFSDTQQ

SEQ ID NO: 211480 - protein, 40 aa, Artificial Sequence
  Description of Artificial Sequence: Synthetic polypeptide
SEAEISTTNPVAYEGYGQCQVCSNWGEDHNAEGFISDTQA

SEQ ID NO: 211481 - protein, 39 aa, Artificial Sequence
  Description of Artificial Sequence: Synthetic polypeptide
SEAEISCTNPVAYEGWGQCSCSNWEALHNAEHFNSDTQA

SEQ ID NO: 211482 - protein, 40 aa, Artificial Sequence
  Description of Artificial Sequence: Synthetic polypeptide
SEMAISTTNPVAYEQYGQCAVCSNWGEAHNAENFISDFQS

SEQ ID NO: 211483 - protein, 39 aa, Artificial Sequence
  Description of Artificial Sequence: Synthetic polypeptide
SEMAISCTNPEATEGYGQCFCSDSGEDHNAENFSSDNQA

SEQ ID NO: 211484 - protein, 37 aa, Artificial Sequence
  Description of Artificial Sequence: Synthetic polypeptide
DETEIATTNPIAYAPWGPTTAAGATDGPAEPKGSPQN

SEQ ID NO: 211485 - protein, 41 aa, Artificial Sequence
  Description of Artificial Sequence: Synthetic polypeptide
CEEEIATTNPVGYTEAAWCGPHVAVLAGDGMNDSGGPMGQR

SEQ ID NO: 211486 - protein, 39 aa, Artificial Sequence
  Description of Artificial Sequence: Synthetic polypeptide
AEAEISCTNPVAYCGYGQCVCSNWGEGDNAENFISETQQ

SEQ ID NO: 211487 - protein, 39 aa, Artificial Sequence
  Description of Artificial Sequence: Synthetic polypeptide
AEAEIACTNPVAYEGYGQCVCGNWGEDHNAEGFISVFQA

SEQ ID NO: 211488 - protein, 39 aa, Artificial Sequence
  Description of Artificial Sequence: Synthetic polypeptide
DEACISCTNPVAYCGYGICVCSNWGEGDNAENFNSEFQA

SEQ ID NO: 211489 - protein, 39 aa, Artificial Sequence
  Description of Artificial Sequence: Synthetic polypeptide
ADAEISTTNPVATEGWGQCVTGNWGEDDNIENFNSDTQA

SEQ ID NO: 211490 - protein, 40 aa, Artificial Sequence
  Description of Artificial Sequence: Synthetic polypeptide
YGWEKIAGATCNPTVSVEQYGSGAISWTMVQDQLGVLETD

SEQ ID NO: 211491 - protein, 39 aa, Artificial Sequence
  Description of Artificial Sequence: Synthetic polypeptide
DDACISTTNPCATEGYGQCVCSNWGEDHNAENFMSDTQM

SEQ ID NO: 211492 - protein, 38 aa, Artificial Sequence
  Description of Artificial Sequence: Synthetic polypeptide
SDACISCTNPVAYEGYGQCVCSNWGEDNAEGFNSDTQI

SEQ ID NO: 211493 - protein, 39 aa, Artificial Sequence
  Description of Artificial Sequence: Synthetic polypeptide
SDACISCTNPVAYEGYGICVCSTWVEDDNTEYFNSDTQA

SEQ ID NO: 211494 - protein, 39 aa, Artificial Sequence
  Description of Artificial Sequence: Synthetic polypeptide
ADAEISTTNPVATCGWGQCVCSNWGEGHNAEYFNSDTQQ

SEQ ID NO: 211495 - protein, 39 aa, Artificial Sequence
  Description of Artificial Sequence: Synthetic polypeptide
ADMCISTTNPVATEHYGQCVCSNWGEDHNAENFISDTQN

SEQ ID NO: 211496 - protein, 39 aa, Artificial Sequence
  Description of Artificial Sequence: Synthetic polypeptide
ADMCISTTNPCAYEQYGQCVCSNSEADDNAENFNSDTQS

SEQ ID NO: 211497 - protein, 39 aa, Artificial Sequence
  Description of Artificial Sequence: Synthetic polypeptide
DETEISTTNPCAYEGWGCQTCQNWEEDDNAENSGSDNQA

SEQ ID NO: 211498 - protein, 39 aa, Artificial Sequence
  Description of Artificial Sequence: Synthetic polypeptide
ADMCISCTNPVAYEGYGICVCSNWEEDTNAENFMSDNQS

SEQ ID NO: 211499 - protein, 39 aa, Artificial Sequence
  Description of Artificial Sequence: Synthetic polypeptide
ADMCISCTNPVAYEGYGICVCSNWEEDTNAEAFNSDTQS

SEQ ID NO: 211500 - protein, 39 aa, Artificial Sequence
  Description of Artificial Sequence: Synthetic polypeptide
ADMCIRTTNPVAYCGYGQCIVCSNWGEHNAENFNSDTQS

SEQ ID NO: 211501 - protein, 39 aa, Artificial Sequence
  Description of Artificial Sequence: Synthetic polypeptide
DENEISTTNPCAYCGYGQCVCSNWGEDHNAENFISDPQS

SEQ ID NO: 211502 - protein, 39 aa, Artificial Sequence
  Description of Artificial Sequence: Synthetic polypeptide
ADMCIGTTNPVAYEQYGQCVCSNWGEAHNAENFISETQS

SEQ ID NO: 211503 - protein, 39 aa, Artificial Sequence
  Description of Artificial Sequence: Synthetic polypeptide
SEMAIGTTNPVAYEGYGQCVCGTWGEDDNAENFISDTQG

SEQ ID NO: 211504 - protein, 39 aa, Artificial Sequence
  Description of Artificial Sequence: Synthetic polypeptide
ADMCIGTTNPVAYEGYGQCSCSNWEALHNAEHFNSDTQA

SEQ ID NO: 211505 - protein, 40 aa, Artificial Sequence
  Description of Artificial Sequence: Synthetic polypeptide
CEEEIATTNPVGYTEAAWCGPHVAVLAGDGNNDSGGDQDQ

SEQ ID NO: 211506 - protein, 40 aa, Artificial Sequence
  Description of Artificial Sequence: Synthetic polypeptide
FEETIRTASPCTTVVEMQWYGFNLCTTTLNTEHWQTPGDN

SEQ ID NO: 211507 - protein, 40 aa, Artificial Sequence
  Description of Artificial Sequence: Synthetic polypeptide
AEMEISTTNPVAYEGYGQCQVCSNWGEDHNAEGFISDTQS

SEQ ID NO: 211508 - protein, 39 aa, Artificial Sequence
  Description of Artificial Sequence: Synthetic polypeptide
SEAEISCTNPVAYCGYGQCVCSNWGEGDNAENFNSENQQ

SEQ ID NO: 211509 - protein, 38 aa, Artificial Sequence
  Description of Artificial Sequence: Synthetic polypeptide
ADACISTTNPVAYEGYGICVCGNWEETNAENFMSDTQS

SEQ ID NO: 211510 - protein, 39 aa, Artificial Sequence
  Description of Artificial Sequence: Synthetic polypeptide
DETEIRTTNPIATECWGATTPANAGDAWSAEPTSTPYIP

SEQ ID NO: 211511 - protein, 40 aa, Artificial Sequence
  Description of Artificial Sequence: Synthetic polypeptide
SEMEIGTTNPVAYEEYGQCQFCSNWGEDHNTENSNSDTQS

SEQ ID NO: 211512 - protein, 38 aa, Artificial Sequence
  Description of Artificial Sequence: Synthetic polypeptide
DDACISCTNPVAYEHYGQCVCSNWGEHNAENFISDTQN

SEQ ID NO: 211513 - protein, 40 aa, Artificial Sequence
  Description of Artificial Sequence: Synthetic polypeptide
DDECISTTNPVAYCGYGICIVCSNWGEDHNAENFNSDTQS

SEQ ID NO: 211514 - protein, 40 aa, Artificial Sequence
  Description of Artificial Sequence: Synthetic polypeptide
DDECISTTNPVAYCQYGQCQVCSNWGEDHNAENFISDTQS

SEQ ID NO: 211515 - protein, 39 aa, Artificial Sequence
  Description of Artificial Sequence: Synthetic polypeptide
DDACISCTNPVAYCQYGQCVCSNWGEGDNAENFNSEFQS

SEQ ID NO: 211516 - protein, 40 aa, Artificial Sequence
  Description of Artificial Sequence: Synthetic polypeptide
DDECISTTNPVAYEGYGQCQVCSNWGEDHNAESFISETQL

SEQ ID NO: 211517 - protein, 39 aa, Artificial Sequence
  Description of Artificial Sequence: Synthetic polypeptide
ADAEIRCTNPVAYEYYGQCVCQNWGEDHNEENFNSDTQF

SEQ ID NO: 211518 - protein, 39 aa, Artificial Sequence
  Description of Artificial Sequence: Synthetic polypeptide
SEACTSTTNPVAYEGWGICVCSDWGEDTNAENFNSDTQS

SEQ ID NO: 211519 - protein, 38 aa, Artificial Sequence
  Description of Artificial Sequence: Synthetic polypeptide
SEACTSTTNPVAYEGWGCVCGDWMEDTNAEYFNSDTQA

SEQ ID NO: 211520 - protein, 39 aa, Artificial Sequence
  Description of Artificial Sequence: Synthetic polypeptide
AENAISTTNPVAYEGYGQCVCSNWGEDHNTEGFISDTQM

SEQ ID NO: 211521 - protein, 38 aa, Artificial Sequence
  Description of Artificial Sequence: Synthetic polypeptide
SEACTSCTNPVAYEGWGCVCSDWGEDTNAEYFNSDTQA

SEQ ID NO: 211522 - protein, 39 aa, Artificial Sequence
  Description of Artificial Sequence: Synthetic polypeptide
SEACTSCTNPVATEGWGQCVCSDWMEDTNAENFNSDTQS

SEQ ID NO: 211523 - protein, 40 aa, Artificial Sequence
  Description of Artificial Sequence: Synthetic polypeptide
DEEAISTTNPVSYEFGYGQCSCQNWMEDHNAENFSSETQA

SEQ ID NO: 211524 - protein, 39 aa, Artificial Sequence
  Description of Artificial Sequence: Synthetic polypeptide
TDACISTTNPVAYEGYGQCVCSNWMEGDNTEHFNSDTQL

SEQ ID NO: 211525 - protein, 39 aa, Artificial Sequence
  Description of Artificial Sequence: Synthetic polypeptide
TDACISTTNPVAYEGYGICVCSNWGEDHNTEHFNSDTQL

SEQ ID NO: 211526 - protein, 39 aa, Artificial Sequence
  Description of Artificial Sequence: Synthetic polypeptide
TDACISTTNPVAYEGYGCQVCSNWGEGHNTEHFNSDTQL

SEQ ID NO: 211527 - protein, 40 aa, Artificial Sequence
  Description of Artificial Sequence: Synthetic polypeptide
SEACISTVNPVATEGYGQCQVCSNWGAPDNAENFNSDTQL

SEQ ID NO: 211528 - protein, 39 aa, Artificial Sequence
  Description of Artificial Sequence: Synthetic polypeptide
DDECISTVNPVAYEGYGQCVCSNWGEDHNAENFISDTQA

SEQ ID NO: 211529 - protein, 39 aa, Artificial Sequence
  Description of Artificial Sequence: Synthetic polypeptide
TDACISCTNPVATEGYGQCVCSNWMEPDNTEHFNSDTQL

SEQ ID NO: 211530 - protein, 38 aa, Artificial Sequence
  Description of Artificial Sequence: Synthetic polypeptide
ADACISTTNPVAYEYYGQCVCSNWGEDNAENFISETQN

SEQ ID NO: 211531 - protein, 40 aa, Artificial Sequence
  Description of Artificial Sequence: Synthetic polypeptide
SEACISTTNPVAYEQYGQCAVCSMWGEDHNTEHFISDTQN

SEQ ID NO: 211532 - protein, 40 aa, Artificial Sequence
  Description of Artificial Sequence: Synthetic polypeptide
SEACISTTNPVAYEQYGQCQVCQNWGEDHNAEGFGSDTQS

SEQ ID NO: 211533 - protein, 40 aa, Artificial Sequence
  Description of Artificial Sequence: Synthetic polypeptide
SEACISTTNPVAYEQYGQCQVCSMWEEDHNDENFISDTQA

SEQ ID NO: 211534 - protein, 39 aa, Artificial Sequence
  Description of Artificial Sequence: Synthetic polypeptide
AEMELSTTNPVAYEGWGQCSCSNWGEAHNAEFFNSVTQP

SEQ ID NO: 211535 - protein, 39 aa, Artificial Sequence
  Description of Artificial Sequence: Synthetic polypeptide
AENCIGCTNPVAYEGYGQCVCSNWGEEHNAEYFNSDNQF

SEQ ID NO: 211536 - protein, 36 aa, Artificial Sequence
  Description of Artificial Sequence: Synthetic polypeptide
DEADCAKCACTNPVAYYAPWGNVAPANNQQHVTEDD

SEQ ID NO: 211537 - protein, 39 aa, Artificial Sequence
  Description of Artificial Sequence: Synthetic polypeptide
ADACISTTNPVAYEGYGQCSCSNWEALHNAEHFNSDNQS

SEQ ID NO: 211538 - protein, 40 aa, Artificial Sequence
  Description of Artificial Sequence: Synthetic polypeptide
SEMCISTTNPVAYEAYGQCQVCSNWGEEHNAEGFNSDTQS

SEQ ID NO: 211539 - protein, 39 aa, Artificial Sequence
  Description of Artificial Sequence: Synthetic polypeptide
SEMCISTTNPVAYEGWGQCQVCSNWGEHNAENSNSETQS

SEQ ID NO: 211540 - protein, 39 aa, Artificial Sequence
  Description of Artificial Sequence: Synthetic polypeptide
SEYCISTTNPVAYEGYGQCVCPNWGEDHNAEHFLSDTQA

SEQ ID NO: 211541 - protein, 39 aa, Artificial Sequence
  Description of Artificial Sequence: Synthetic polypeptide
SEMCISTTNPVAYEGYGQCVCENWGEDHNAEYFFSDTQQ

SEQ ID NO: 211542 - protein, 39 aa, Artificial Sequence
  Description of Artificial Sequence: Synthetic polypeptide
SEACISTTNPVAYEGWGQCSCSNWEALPNAEYFNSDTQS

SEQ ID NO: 211543 - protein, 39 aa, Artificial Sequence
  Description of Artificial Sequence: Synthetic polypeptide
DDSEVACTNPVSTEGYGICVCGTWGEDHNAEYFGSQTQA

SEQ ID NO: 211544 - protein, 40 aa, Artificial Sequence
  Description of Artificial Sequence: Synthetic polypeptide
SEMCISTTNPVAYEQYGQCAVCSNWGEDHNAEYFFSETQS

SEQ ID NO: 211545 - protein, 39 aa, Artificial Sequence
  Description of Artificial Sequence: Synthetic polypeptide
ADACISTTNPVAYEGYGICVCSNWEEDTNAENFISDTQS

SEQ ID NO: 211546 - protein, 40 aa, Artificial Sequence
  Description of Artificial Sequence: Synthetic polypeptide
SEACISTTNPVAYEGYGQCQVCSNWEEDHNAENFGSEFQS

SEQ ID NO: 211547 - protein, 39 aa, Artificial Sequence
  Description of Artificial Sequence: Synthetic polypeptide
DEMCISTTNPVAYEGWGQCVTGNWGEDHNIENFISDTQA

SEQ ID NO: 211548 - protein, 39 aa, Artificial Sequence
  Description of Artificial Sequence: Synthetic polypeptide
DEAAISCVNPVAYEGYGQCVCSNWGEADNTENFISDPQA

SEQ ID NO: 211549 - protein, 39 aa, Artificial Sequence
  Description of Artificial Sequence: Synthetic polypeptide
DDACISTTNPVATCGWGQCVCSNWGEGDNAEYFNSDTQQ

SEQ ID NO: 211550 - protein, 40 aa, Artificial Sequence
  Description of Artificial Sequence: Synthetic polypeptide
CEECISCTNPVAYEQWGQCICCSMSGEDHNAENFNSDTQA

SEQ ID NO: 211551 - protein, 40 aa, Artificial Sequence
  Description of Artificial Sequence: Synthetic polypeptide
SEAEIGTTNPVAYEGYGQCQFCGVWGEDDNAESFNSDTQS

SEQ ID NO: 211552 - protein, 40 aa, Artificial Sequence
  Description of Artificial Sequence: Synthetic polypeptide
TEECISTTNPVAYEGWGQCAVCSNWGEDTNAEFFSSDTQS

SEQ ID NO: 211553 - protein, 39 aa, Artificial Sequence
  Description of Artificial Sequence: Synthetic polypeptide
TEECISTTNPCAYEGYGQCVCSNSEEDHNAENFISDTQS

SEQ ID NO: 211554 - protein, 41 aa, Artificial Sequence
  Description of Artificial Sequence: Synthetic polypeptide
SNDSEREIWTTNPSSATEFCNGVCQVFTEGDLVRDYDDSKQ

SEQ ID NO: 211555 - protein, 39 aa, Artificial Sequence
  Description of Artificial Sequence: Synthetic polypeptide
DEETTTRATNPCIGAACIWGVVEVSVTMELLMRQAVPDQ

SEQ ID NO: 211556 - protein, 39 aa, Artificial Sequence
  Description of Artificial Sequence: Synthetic polypeptide
DEEVIACTNPVATEQWGCTTIFAGAGMHGGPDDSGEGAQ

SEQ ID NO: 211557 - protein, 39 aa, Artificial Sequence
  Description of Artificial Sequence: Synthetic polypeptide
SAQQIATTNPVAYEPWGHVPICAMTAGIGIATPGDNGRP

SEQ ID NO: 211558 - protein, 38 aa, Artificial Sequence
  Description of Artificial Sequence: Synthetic polypeptide
DDSEVACTNPVSTEGYGCVCGNWGEDINIEYFGSQTQA

SEQ ID NO: 211559 - protein, 38 aa, Artificial Sequence
  Description of Artificial Sequence: Synthetic polypeptide
DEECISCTNPVSYCGYGQCVCVNWGEHNAENFNSETQA

SEQ ID NO: 211560 - protein, 39 aa, Artificial Sequence
  Description of Artificial Sequence: Synthetic polypeptide
DEECISTTNPCAYEGWGQCVCGNWGEDDNDESFNSDTQA

SEQ ID NO: 211561 - protein, 40 aa, Artificial Sequence
  Description of Artificial Sequence: Synthetic polypeptide
DDACIRTTNPVAYEGYGQCIVCQNWGYDHNAESFNSETQS

SEQ ID NO: 211562 - protein, 41 aa, Artificial Sequence
  Description of Artificial Sequence: Synthetic polypeptide
TEECYRTDTIPVAITKEFFYKFSCTYSIFQNLTHGMSICKN

SEQ ID NO: 211563 - protein, 38 aa, Artificial Sequence
  Description of Artificial Sequence: Synthetic polypeptide
DETEIATTNPIAYAPWGATTAANATDGPAEPKGSPQNA

SEQ ID NO: 211564 - protein, 39 aa, Artificial Sequence
  Description of Artificial Sequence: Synthetic polypeptide
DDACISTTNPCAYEGYGQCVCSNSEADDNAENFNSDTQS

SEQ ID NO: 211565 - protein, 39 aa, Artificial Sequence
  Description of Artificial Sequence: Synthetic polypeptide
SDAEISTTNPVAYCHYGQCVCSTWEEAHNAESFISDTQA

SEQ ID NO: 211566 - protein, 38 aa, Artificial Sequence
  Description of Artificial Sequence: Synthetic polypeptide
DEGEIATTNPCAYAPWGATTAANATDGPAEPKGSPQNT

SEQ ID NO: 211567 - protein, 40 aa, Artificial Sequence
  Description of Artificial Sequence: Synthetic polypeptide
AEACISTTNPVAYEYYGQCQCCSNWGADHNTENFGSDNQP

SEQ ID NO: 211568 - protein, 40 aa, Artificial Sequence
  Description of Artificial Sequence: Synthetic polypeptide
AEMEISTTNPVAYEGWGICQVCSNWGEDHNAENSNSETQS

SEQ ID NO: 211569 - protein, 40 aa, Artificial Sequence
  Description of Artificial Sequence: Synthetic polypeptide
CEEEIATTNPVGYTEAAWCGPHFAVLAGDGMNDSGGPQDQ

SEQ ID NO: 211570 - protein, 39 aa, Artificial Sequence
  Description of Artificial Sequence: Synthetic polypeptide
AEMEISTTNPVAYEGWGQCVCGMWGEDDNAEAFNSDNQM

SEQ ID NO: 211571 - protein, 37 aa, Artificial Sequence
  Description of Artificial Sequence: Synthetic polypeptide
DETEIACTNPTAYECWGATTWANATDGPAEPAIGPKN

SEQ ID NO: 211572 - protein, 39 aa, Artificial Sequence
  Description of Artificial Sequence: Synthetic polypeptide
AEACISTTNPVAYEYYGQCVCSNWMEDDNAENFPSETQS

SEQ ID NO: 211573 - protein, 40 aa, Artificial Sequence
  Description of Artificial Sequence: Synthetic polypeptide
DEECISCTNPVATEGYGQCQICSNWEEDHNIENFFSDTQQ

SEQ ID NO: 211574 - protein, 39 aa, Artificial Sequence
  Description of Artificial Sequence: Synthetic polypeptide
ADACISTTNPVATEQYGQCFCGNSMEDENAENFISDTQN

SEQ ID NO: 211575 - protein, 39 aa, Artificial Sequence
  Description of Artificial Sequence: Synthetic polypeptide
AEACTSTTNPVATEQWGQCVCPNWGEDHNAENFMSETQS

SEQ ID NO: 211576 - protein, 40 aa, Artificial Sequence
  Description of Artificial Sequence: Synthetic polypeptide
SEEAISTTNPVAYEGYGQCAVCSNWGEADNAENFISDFQS

SEQ ID NO: 211577 - protein, 39 aa, Artificial Sequence
  Description of Artificial Sequence: Synthetic polypeptide
DEGEIATTNPCAYAPWGHATTSANATDGPAEPKGSPLNN

SEQ ID NO: 211578 - protein, 38 aa, Artificial Sequence
  Description of Artificial Sequence: Synthetic polypeptide
DDAEVASTNPVSTEGYGCVCQNWGEDDNAEYFNSQTQA

SEQ ID NO: 211579 - protein, 39 aa, Artificial Sequence
  Description of Artificial Sequence: Synthetic polypeptide
DDACISTTNPVAYEHYGQCVCSMWGEDHNAENFISQTQS

SEQ ID NO: 211580 - protein, 40 aa, Artificial Sequence
  Description of Artificial Sequence: Synthetic polypeptide
ADMEISTTNPVAYCQYGQCIVCSNWGEDHNAENFNSDTQS

SEQ ID NO: 211581 - protein, 39 aa, Artificial Sequence
  Description of Artificial Sequence: Synthetic polypeptide
DDACISTTNPVAYEGYGQCVCSNWGEAHNAENFISETQS

SEQ ID NO: 211582 - protein, 40 aa, Artificial Sequence
  Description of Artificial Sequence: Synthetic polypeptide
AEEAISTTNPVAYEAYGQCQVCSNWGEDHNAEGFISDTQN

SEQ ID NO: 211583 - protein, 39 aa, Artificial Sequence
  Description of Artificial Sequence: Synthetic polypeptide
DDACISTTNPVAYEGYGQCVCSMWMEDHNAENFISDTQS

SEQ ID NO: 211584 - protein, 40 aa, Artificial Sequence
  Description of Artificial Sequence: Synthetic polypeptide
CEEEIATTNPVAYAPIWTHVFVPAGNSGEPTQGVQDNHSM

SEQ ID NO: 211585 - protein, 40 aa, Artificial Sequence
  Description of Artificial Sequence: Synthetic polypeptide
DDACISTTNPVAYEGYGQCAVCSNWEEDHNAENFNSEFQS

SEQ ID NO: 211586 - protein, 41 aa, Artificial Sequence
  Description of Artificial Sequence: Synthetic polypeptide
DENCISTTNPVAYETGYGQCQVCSNWEEDHNIEHFNSDTQA

SEQ ID NO: 211587 - protein, 38 aa, Artificial Sequence
  Description of Artificial Sequence: Synthetic polypeptide
DETEIATTNPCAYAPWGATTAALATDGPAEAKGNPQNH

SEQ ID NO: 211588 - protein, 38 aa, Artificial Sequence
  Description of Artificial Sequence: Synthetic polypeptide
DETEIATTNPCAYAPWGATTAALATDGPAEAKMNPMNA

SEQ ID NO: 211589 - protein, 38 aa, Artificial Sequence
  Description of Artificial Sequence: Synthetic polypeptide
DETEIATTNPCAYAPWGATTAALATDGPAEPKANPQMA

SEQ ID NO: 211590 - protein, 39 aa, Artificial Sequence
  Description of Artificial Sequence: Synthetic polypeptide
SDAEISTTNPVAYEGYGQCAVCSNWGEHNAENFISDTQS

SEQ ID NO: 211591 - protein, 39 aa, Artificial Sequence
  Description of Artificial Sequence: Synthetic polypeptide
SEREISTTNPCATEGYGQCICQNWMEDPNAENFNSDTQS

SEQ ID NO: 211592 - protein, 39 aa, Artificial Sequence
  Description of Artificial Sequence: Synthetic polypeptide
ADNCIATTNPVATCGYGQCVCSNWGEDDNAEGFNSDTQS

SEQ ID NO: 211593 - protein, 39 aa, Artificial Sequence
  Description of Artificial Sequence: Synthetic polypeptide
AEAEISTTNPVAYCGYGQCVCSNWMEDHNAENFISDPQS

SEQ ID NO: 211594 - protein, 39 aa, Artificial Sequence
  Description of Artificial Sequence: Synthetic polypeptide
AEACISTTNPVAYEGYGQCVCSNSGEDPNAEHFISETQS

SEQ ID NO: 211595 - protein, 39 aa, Artificial Sequence
  Description of Artificial Sequence: Synthetic polypeptide
AEACISTTNPVAYEGYGQCVCSNWGEDHNAENFISDTQN

SEQ ID NO: 211596 - protein, 40 aa, Artificial Sequence
  Description of Artificial Sequence: Synthetic polypeptide
DEAAIGTTNPVAYEGYGQCQVCGTWGEDDNAENFSSDTQG

SEQ ID NO: 211597 - protein, 40 aa, Artificial Sequence
  Description of Artificial Sequence: Synthetic polypeptide
DAQQIATTNPVAYEPWGHSPICAGMTAGIGIATGSDNGRP

SEQ ID NO: 211598 - protein, 39 aa, Artificial Sequence
  Description of Artificial Sequence: Synthetic polypeptide
SEECISCTNPVAYEGYGQCVCGVWGYPHNAEYFNSDNQS

SEQ ID NO: 211599 - protein, 40 aa, Artificial Sequence
  Description of Artificial Sequence: Synthetic polypeptide
SEECISCTNPVAYEGYGQCQVCSNWGEDPNTEYFLSDNQA

SEQ ID NO: 211600 - protein, 43 aa, Artificial Sequence
  Description of Artificial Sequence: Synthetic polypeptide
LIEGEEIGRKTTTPVVTEQFNGYSFVGCVMVLQQENGSGDHPD

SEQ ID NO: 211601 - protein, 39 aa, Artificial Sequence
  Description of Artificial Sequence: Synthetic polypeptide
DEACISCTNPCAYEGYGQCVCSNSEADHNAENFNSDTQA

SEQ ID NO: 211602 - protein, 40 aa, Artificial Sequence
  Description of Artificial Sequence: Synthetic polypeptide
DEECISTVNPVAYEGYGQCAVCGNWGEDHNAENSISDTQF

SEQ ID NO: 211603 - protein, 39 aa, Artificial Sequence
  Description of Artificial Sequence: Synthetic polypeptide
DAQQIATTNPVAYEPWGHSPICAMTAGIGIATGMDNGFP

SEQ ID NO: 211604 - protein, 40 aa, Artificial Sequence
  Description of Artificial Sequence: Synthetic polypeptide
DAQQIATTNPVAYEPWGHSPICATMTAGIGIATGGDNARP

SEQ ID NO: 211605 - protein, 40 aa, Artificial Sequence
  Description of Artificial Sequence: Synthetic polypeptide
SERAISTTNPVAYEGYGQCQVCSNWGYGHNAEHFPSDTQG

SEQ ID NO: 211606 - protein, 39 aa, Artificial Sequence
  Description of Artificial Sequence: Synthetic polypeptide
KEENELCKKCEWNWVWYEVDVSVWTENELFQTRPDNQIT

SEQ ID NO: 211607 - protein, 39 aa, Artificial Sequence
  Description of Artificial Sequence: Synthetic polypeptide
DAQQIATTNPVAYEPWGHVPICAMTAGIGIATGGDNGAP

SEQ ID NO: 211608 - protein, 39 aa, Artificial Sequence
  Description of Artificial Sequence: Synthetic polypeptide
AEMEISTTNPCAYEGYGQCICSNWMEDPNAENFNSDTQS

SEQ ID NO: 211609 - protein, 40 aa, Artificial Sequence
  Description of Artificial Sequence: Synthetic polypeptide
DEMEISCTNPVAYCQYGQCQVCQNSGEEHNAEGFISDTQS

SEQ ID NO: 211610 - protein, 38 aa, Artificial Sequence
  Description of Artificial Sequence: Synthetic polypeptide
DDSEVASTNPVSTEGYGCVCQNWGEDHNQEYFSSQTQA

SEQ ID NO: 211611 - protein, 39 aa, Artificial Sequence
  Description of Artificial Sequence: Synthetic polypeptide
AEMEISTTNPCAYEGYGQCVCQNWGADHNAENFISDPQS

SEQ ID NO: 211612 - protein, 39 aa, Artificial Sequence
  Description of Artificial Sequence: Synthetic polypeptide
SERCISTTNPVAYEAYGQCVCGTWGEDDNAEGFFSDTQS

SEQ ID NO: 211613 - protein, 39 aa, Artificial Sequence
  Description of Artificial Sequence: Synthetic polypeptide
DETASCFAACTNPVAYEQWGHCNVSAAGLSENSVDDQRN

SEQ ID NO: 211614 - protein, 39 aa, Artificial Sequence
  Description of Artificial Sequence: Synthetic polypeptide
AENCISTTNPVAYCGYGQCVCSNSGEDPNAENFNSQTQL

SEQ ID NO: 211615 - protein, 38 aa, Artificial Sequence
  Description of Artificial Sequence: Synthetic polypeptide
ADNCISTTNPVAYCGYGCVCSNWGEDDNAEGFNSDTQA

SEQ ID NO: 211616 - protein, 39 aa, Artificial Sequence
  Description of Artificial Sequence: Synthetic polypeptide
SEREISCTNPVAYEAYGQCVCGNWGEDDNAEGFFSDTQS

SEQ ID NO: 211617 - protein, 39 aa, Artificial Sequence
  Description of Artificial Sequence: Synthetic polypeptide
AEAEISTTNPVAYCGYGQCVCVNWGADHNAENFTSDTQA

SEQ ID NO: 211618 - protein, 39 aa, Artificial Sequence
  Description of Artificial Sequence: Synthetic polypeptide
TEMAISCVNPVAYEQYGQCVCSNWGEDDNTENFNSDPQA

SEQ ID NO: 211619 - protein, 38 aa, Artificial Sequence
  Description of Artificial Sequence: Synthetic polypeptide
DETEIATTNPCAYAPWGATTAALATDGPANPKMNPKNV

SEQ ID NO: 211620 - protein, 37 aa, Artificial Sequence
  Description of Artificial Sequence: Synthetic polypeptide
DETEIATTNPCAYAPWGATTPALATDGPAEPKGSPQN

SEQ ID NO: 211621 - protein, 41 aa, Artificial Sequence
  Description of Artificial Sequence: Synthetic polypeptide
FPSEVTVISGTTNPVFATEMYGMVEWVVISQQQFRQTPVRG

SEQ ID NO: 211622 - protein, 40 aa, Artificial Sequence
  Description of Artificial Sequence: Synthetic polypeptide
SDAEIATTNPVATEGWGQCQVCSNWGEDDNAENSNSETQA

SEQ ID NO: 211623 - protein, 39 aa, Artificial Sequence
  Description of Artificial Sequence: Synthetic polypeptide
AEAEISCTNPVAYEYYGQCVCQNWGEDHNTENFGSDTQF

SEQ ID NO: 211624 - protein, 39 aa, Artificial Sequence
  Description of Artificial Sequence: Synthetic polypeptide
SEAETSTTNPVAYEGWGQCVCQDWMEDTNAEYFNSDTQA

SEQ ID NO: 211625 - protein, 39 aa, Artificial Sequence
  Description of Artificial Sequence: Synthetic polypeptide
SEAETACTNPVAYEGWGQCVCSDWGEDTNAENFNSDTQS

SEQ ID NO: 211626 - protein, 39 aa, Artificial Sequence
  Description of Artificial Sequence: Synthetic polypeptide
DETEIRTTNPIAYECWGKTTPANAGDAWSSEPTGAPYIF

SEQ ID NO: 211627 - protein, 39 aa, Artificial Sequence
  Description of Artificial Sequence: Synthetic polypeptide
DDACISTTNPVATEHWGQCVCSNWGEDHNAENFISDTQN

SEQ ID NO: 211628 - protein, 39 aa, Artificial Sequence
  Description of Artificial Sequence: Synthetic polypeptide
DENCISTTNPCAYEGYGQCVCSNWMEDHNAENFISDPQS

SEQ ID NO: 211629 - protein, 39 aa, Artificial Sequence
  Description of Artificial Sequence: Synthetic polypeptide
ADMCISTTNPVAYEGYGQCSCSNWEALDNIEYFNSDTQA

SEQ ID NO: 211630 - protein, 39 aa, Artificial Sequence
  Description of Artificial Sequence: Synthetic polypeptide
SEAEISTVNPVAYEGYGQCVCSNSGEDHNAENFSSEPQA

SEQ ID NO: 211631 - protein, 38 aa, Artificial Sequence
  Description of Artificial Sequence: Synthetic polypeptide
SEMEISCTNPCAYEGYGCICSNWMEDPNAENFNSDTQS

SEQ ID NO: 211632 - protein, 39 aa, Artificial Sequence
  Description of Artificial Sequence: Synthetic polypeptide
SEACISTTNPEATEGYGQCSCYNWGEEHNAENFNSVTQA

SEQ ID NO: 211633 - protein, 40 aa, Artificial Sequence
  Description of Artificial Sequence: Synthetic polypeptide
DEMAISTTNPVSTEFGYGQCSCQNWGEDHNAENFSSETQA

SEQ ID NO: 211634 - protein, 40 aa, Artificial Sequence
  Description of Artificial Sequence: Synthetic polypeptide
AEECISTTNPVAYEEYGQCQVCSNWGEPHNTEHFISDFQA

SEQ ID NO: 211635 - protein, 39 aa, Artificial Sequence
  Description of Artificial Sequence: Synthetic polypeptide
AEEAISCTNPVAYEGYGQCVCSNWGEDHNAEGFSSDTQN

SEQ ID NO: 211636 - protein, 40 aa, Artificial Sequence
  Description of Artificial Sequence: Synthetic polypeptide
AEEAIRTTNPVSYEFGYGQCSCQNWGEDHNAENFSSETQA

SEQ ID NO: 211637 - protein, 40 aa, Artificial Sequence
  Description of Artificial Sequence: Synthetic polypeptide
AEAEISTTNPCATCGYGQCQVCSNWGEDHNAEFFNSDTAS

SEQ ID NO: 211638 - protein, 40 aa, Artificial Sequence
  Description of Artificial Sequence: Synthetic polypeptide
ADMCISTTNPVAYEQYGQCIVCSNWGEDHNAESFNSETQL

SEQ ID NO: 211639 - protein, 40 aa, Artificial Sequence
  Description of Artificial Sequence: Synthetic polypeptide
DDACISTTNPVATEGYGQCQVCSNWGEAHNAENFISETQA

SEQ ID NO: 211640 - protein, 39 aa, Artificial Sequence
  Description of Artificial Sequence: Synthetic polypeptide
ADMCISTTNPVAYEQYGQCVCSNWMEAHNAENFISETQA

SEQ ID NO: 211641 - protein, 39 aa, Artificial Sequence
  Description of Artificial Sequence: Synthetic polypeptide
CEDEIATTNPVAYFEPPWGRPPPAGQGPALTHQDGMEAV

SEQ ID NO: 211642 - protein, 40 aa, Artificial Sequence
  Description of Artificial Sequence: Synthetic polypeptide
SEAVVIHCCTNPVAYYYMPPWGSPSATANQGGQPMGNGLE

SEQ ID NO: 211643 - protein, 40 aa, Artificial Sequence
  Description of Artificial Sequence: Synthetic polypeptide
DDACISTTNPVATEGYGQCAVCSNWGEDDNAENFISDTQS

SEQ ID NO: 211644 - protein, 38 aa, Artificial Sequence
  Description of Artificial Sequence: Synthetic polypeptide
SEAVIACTNPVATEQWGCIWNAAMNNEEADPSMSEDGN

SEQ ID NO: 211645 - protein, 41 aa, Artificial Sequence
  Description of Artificial Sequence: Synthetic polypeptide
CEEEIATTNPVGYTEAAWCGPHVAVLAGAGMNDSGGPNDQH

SEQ ID NO: 211646 - protein, 39 aa, Artificial Sequence
  Description of Artificial Sequence: Synthetic polypeptide
SEDEIATTNPVAYEPIWGGCTVAANNGGTIANPDDNMGH

SEQ ID NO: 211647 - protein, 40 aa, Artificial Sequence
  Description of Artificial Sequence: Synthetic polypeptide
DDACISTTNPVAYEEYGQCIVCSNWGYDHNAESFNSETQL

SEQ ID NO: 211648 - protein, 37 aa, Artificial Sequence
  Description of Artificial Sequence: Synthetic polypeptide
DETEIATTNPIAYADPWGATTAAGATDGPAEPKGEQN

SEQ ID NO: 211649 - protein, 38 aa, Artificial Sequence
  Description of Artificial Sequence: Synthetic polypeptide
DETEIATTNPIAYADPWGATTAAGATDGPAEAKGNPQN

SEQ ID NO: 211650 - protein, 40 aa, Artificial Sequence
  Description of Artificial Sequence: Synthetic polypeptide
DDACISTTNPVAYEEYGICQVCSNSGEEDNAENFNSDTQN

SEQ ID NO: 211651 - protein, 38 aa, Artificial Sequence
  Description of Artificial Sequence: Synthetic polypeptide
DETEIATTNPCAYAPWGCATTWANATDGPAEPKPSPQN

SEQ ID NO: 211652 - protein, 39 aa, Artificial Sequence
  Description of Artificial Sequence: Synthetic polypeptide
DETEIATTNPCAYAPWGHATTAALATDGPANPKMNPSNA

SEQ ID NO: 211653 - protein, 37 aa, Artificial Sequence
  Description of Artificial Sequence: Synthetic polypeptide
DDAEVACTNPVSYEGYGCVCGNWGEDNQEYFISQTQA

SEQ ID NO: 211654 - protein, 40 aa, Artificial Sequence
  Description of Artificial Sequence: Synthetic polypeptide
SEEEISCTNPVAYEGYGQCQVCSNWGEDHNAENFISDTQT

SEQ ID NO: 211655 - protein, 38 aa, Artificial Sequence
  Description of Artificial Sequence: Synthetic polypeptide
DETEIATTNPCAYAPWGTTTPANATDGPAEPKGSPQNH

SEQ ID NO: 211656 - protein, 40 aa, Artificial Sequence
  Description of Artificial Sequence: Synthetic polypeptide
DDACISTTNPVAYCQYGQCIVCSNWGEDHNAEYFNSDTQS

SEQ ID NO: 211657 - protein, 39 aa, Artificial Sequence
  Description of Artificial Sequence: Synthetic polypeptide
AENCISCTNPVATCGYGQCVCSNWGEDDNAEGFNSDTQS

SEQ ID NO: 211658 - protein, 39 aa, Artificial Sequence
  Description of Artificial Sequence: Synthetic polypeptide
EETEIATTNPIATECWGATYYANENDHQLHEKTGHKGMS

SEQ ID NO: 211659 - protein, 39 aa, Artificial Sequence
  Description of Artificial Sequence: Synthetic polypeptide
DEECISCTNPVAYCGYGQCVCSNWGEDHNAENFISDPQS

SEQ ID NO: 211660 - protein, 40 aa, Artificial Sequence
  Description of Artificial Sequence: Synthetic polypeptide
DEEAISTTNPVSYEFGYGQCFCQNWGEDHNAENFSSETQS

SEQ ID NO: 211661 - protein, 40 aa, Artificial Sequence
  Description of Artificial Sequence: Synthetic polypeptide
DDMCIACTNPVAYEGYGQCIVCSNWGEDHNAESFGSETQL

SEQ ID NO: 211662 - protein, 40 aa, Artificial Sequence
  Description of Artificial Sequence: Synthetic polypeptide
AENCISTTNPVAYEGYGQCQVCSNWEEDHNAEYFISEFQS

SEQ ID NO: 211663 - protein, 38 aa, Artificial Sequence
  Description of Artificial Sequence: Synthetic polypeptide
ADACLSTTNPVAYEGYGQCICSDWMEDNAEYSNSDTQA

SEQ ID NO: 211664 - protein, 40 aa, Artificial Sequence
  Description of Artificial Sequence: Synthetic polypeptide
ADAAISTTNPVAYEGGYGQCVCSNWGEPDNAENFNSDTQS

SEQ ID NO: 211665 - protein, 40 aa, Artificial Sequence
  Description of Artificial Sequence: Synthetic polypeptide
NERAISCTNPVAYEGYGQCQVCSNWGYGDNAENFPSDTQG

SEQ ID NO: 211666 - protein, 38 aa, Artificial Sequence
  Description of Artificial Sequence: Synthetic polypeptide
YHEPEVIVRYADTVVIVASTFLGSEMSLSTLEVIVGPV

SEQ ID NO: 211667 - protein, 43 aa, Artificial Sequence
  Description of Artificial Sequence: Synthetic polypeptide
YIEYEEIGRKTTTPVNTEQCNGYSFVGHVMVIQQENGSGDHPD

SEQ ID NO: 211668 - protein, 40 aa, Artificial Sequence
  Description of Artificial Sequence: Synthetic polypeptide
DEESIACTNPVAYYEPNWGGCFPCAPTGELIGGPMEDTSK

SEQ ID NO: 211669 - protein, 39 aa, Artificial Sequence
  Description of Artificial Sequence: Synthetic polypeptide
DSMELSTTNPVAYEGWGQCICSDWMEDDNAENSNSDTQS

SEQ ID NO: 211670 - protein, 41 aa, Artificial Sequence
  Description of Artificial Sequence: Synthetic polypeptide
CEEEIATTNPVGYTEAAWCGPHVAVLAGDGMENDSGGPYDQ

SEQ ID NO: 211671 - protein, 40 aa, Artificial Sequence
  Description of Artificial Sequence: Synthetic polypeptide
AENCISCTNPVAYEGYGICAVCSNWEEDHNAEYFNSEFQS

SEQ ID NO: 211672 - protein, 41 aa, Artificial Sequence
  Description of Artificial Sequence: Synthetic polypeptide
AEMEVISCTNPCAYEQYGQCQVCSNWGEDDNAEYFISDNQS

SEQ ID NO: 211673 - protein, 39 aa, Artificial Sequence
  Description of Artificial Sequence: Synthetic polypeptide
ADACISTTNPCAYEGYGQCVCSNSEADHNAENFGSDTQA

SEQ ID NO: 211674 - protein, 39 aa, Artificial Sequence
  Description of Artificial Sequence: Synthetic polypeptide
NEMCISTTNPVAYCGYGQCICSNWGEDENTEGFISDNAS

SEQ ID NO: 211675 - protein, 39 aa, Artificial Sequence
  Description of Artificial Sequence: Synthetic polypeptide
ADACISCTNPVAYEGYGICVCSNWEEATNAENFMSDTQS

SEQ ID NO: 211676 - protein, 39 aa, Artificial Sequence
  Description of Artificial Sequence: Synthetic polypeptide
ADAEISTTNPCAYEGYGQCICSNWMEDPNAENFGSDTQS

SEQ ID NO: 211677 - protein, 39 aa, Artificial Sequence
  Description of Artificial Sequence: Synthetic polypeptide
DDMCISTTNPCAYEGYGQCVCSNSEADHNAENFISDTQA

SEQ ID NO: 211678 - protein, 39 aa, Artificial Sequence
  Description of Artificial Sequence: Synthetic polypeptide
DEMCISTTNPCAYEGYGQCICSNWMEDPNAENFISDTQS

SEQ ID NO: 211679 - protein, 41 aa, Artificial Sequence
  Description of Artificial Sequence: Synthetic polypeptide
CEEEIATTNPVGYTEAAWCGPHVAILAGDGMNDSGGPQDQQ

SEQ ID NO: 211680 - protein, 39 aa, Artificial Sequence
  Description of Artificial Sequence: Synthetic polypeptide
ADACISTTNPVAYEGYGICVCSNWEEDHNAEHFMSDTQS

SEQ ID NO: 211681 - protein, 42 aa, Artificial Sequence
  Description of Artificial Sequence: Synthetic polypeptide
CEEEIATTNPVGYTEAAVWCGPHVAVLAGDGMLNDSGGPNDQ

SEQ ID NO: 211682 - protein, 42 aa, Artificial Sequence
  Description of Artificial Sequence: Synthetic polypeptide
CEEEIATTNPVGYTEAAWCGPHVAVLAGDGMMNDMGGPNDQE

SEQ ID NO: 211683 - protein, 41 aa, Artificial Sequence
  Description of Artificial Sequence: Synthetic polypeptide
CEEEIATTNPVGYTEAAWCGPHVAVLAGDGMFNDSGHPNGQ

SEQ ID NO: 211684 - protein, 40 aa, Artificial Sequence
  Description of Artificial Sequence: Synthetic polypeptide
AEECISTVNPVAYEYYGQCIVCSNWGEAHNAENFTSDTQP

SEQ ID NO: 211685 - protein, 41 aa, Artificial Sequence
  Description of Artificial Sequence: Synthetic polypeptide
CEEEIATTNPVGYTEAAWCGPHVAVLAGDGMMNDSGMDNDQ

SEQ ID NO: 211686 - protein, 40 aa, Artificial Sequence
  Description of Artificial Sequence: Synthetic polypeptide
ADAAISTTNPVAYEEYWGQCVCSNWGEDDNTEYFNGQTQS

SEQ ID NO: 211687 - protein, 40 aa, Artificial Sequence
  Description of Artificial Sequence: Synthetic polypeptide
CEECISTTNPVSYEGGYGQCQVCGNWGENNAEHSNSDTQA

SEQ ID NO: 211688 - protein, 40 aa, Artificial Sequence
  Description of Artificial Sequence: Synthetic polypeptide
AENCIRCTNPVAYEGYGICQVCSNWEEDHNAENFISEFQS

SEQ ID NO: 211689 - protein, 39 aa, Artificial Sequence
  Description of Artificial Sequence: Synthetic polypeptide
AEMEISCTNPVAYEGWGCQVCSNWGEDHNAENSSSETQS

SEQ ID NO: 211690 - protein, 39 aa, Artificial Sequence
  Description of Artificial Sequence: Synthetic polypeptide
AEMEISCTNPVAYEGWGQCQVCSNWGEHNAENSISETQS

SEQ ID NO: 211691 - protein, 40 aa, Artificial Sequence
  Description of Artificial Sequence: Synthetic polypeptide
DDMCIATTNPVAYCQYGQCIVCSNWGEDHNAENFSSDTQS

SEQ ID NO: 211692 - protein, 41 aa, Artificial Sequence
  Description of Artificial Sequence: Synthetic polypeptide
CEEEIATTNPVYGYTEAAWCGPHVAVLAGDGMNDSGDPQDQ

SEQ ID NO: 211693 - protein, 39 aa, Artificial Sequence
  Description of Artificial Sequence: Synthetic polypeptide
ADACISTTNPVAYEGYGCIVCSNWGYDHNAESFSSETQA

SEQ ID NO: 211694 - protein, 38 aa, Artificial Sequence
  Description of Artificial Sequence: Synthetic polypeptide
DETEIAATNPCAYAPWGATTAALATDGPANPKGNPQNA

SEQ ID NO: 211695 - protein, 39 aa, Artificial Sequence
  Description of Artificial Sequence: Synthetic polypeptide
CDMCISTTNPVCYEQYGQCVTGDWGEDTNAEYFISDTAM

SEQ ID NO: 211696 - protein, 40 aa, Artificial Sequence
  Description of Artificial Sequence: Synthetic polypeptide
SEMEIACTNPVAYEGYGQCQYCSNWGEDHNIEYFNGDTQD

SEQ ID NO: 211697 - protein, 40 aa, Artificial Sequence
  Description of Artificial Sequence: Synthetic polypeptide
SEMEIACVNPVAYEQYGQCAVCQNWMEDHNAEYFSSDNQS

SEQ ID NO: 211698 - protein, 39 aa, Artificial Sequence
  Description of Artificial Sequence: Synthetic polypeptide
SQAEISTTNPVAYCGWGICVCSNWGEGHNAEYFISDTQQ

SEQ ID NO: 211699 - protein, 39 aa, Artificial Sequence
  Description of Artificial Sequence: Synthetic polypeptide
SQAEIATTNPVAYCGWGQCVCSNWGEGDNAEYFISDTQQ

SEQ ID NO: 211700 - protein, 39 aa, Artificial Sequence
  Description of Artificial Sequence: Synthetic polypeptide
SDACISCTNPVAYCQYGQCVCSNWGPDHNAEYFGSDTQA

SEQ ID NO: 211701 - protein, 39 aa, Artificial Sequence
  Description of Artificial Sequence: Synthetic polypeptide
SEYAIACVNPVAYEGYGQCAVCSNWMEHNAENFSSDNQS

SEQ ID NO: 211702 - protein, 40 aa, Artificial Sequence
  Description of Artificial Sequence: Synthetic polypeptide
DDACIRTTNPVAYEGYGGQCYCYNWEEDHNAESFNSDTQA

SEQ ID NO: 211703 - protein, 40 aa, Artificial Sequence
  Description of Artificial Sequence: Synthetic polypeptide
AEAEIACTNPVAYEGWGQCVVCSNWGEPDNTENSPSDTQG

SEQ ID NO: 211704 - protein, 39 aa, Artificial Sequence
  Description of Artificial Sequence: Synthetic polypeptide
ADMCISTTNPVAYEGYGICVCSNWEEDDNAENFMSDTQS

SEQ ID NO: 211705 - protein, 39 aa, Artificial Sequence
  Description of Artificial Sequence: Synthetic polypeptide
SDACISTTNPVAYEAYGQCVCSNWMEEHNAEGFISDTQS

SEQ ID NO: 211706 - protein, 38 aa, Artificial Sequence
  Description of Artificial Sequence: Synthetic polypeptide
SDACTSTTNPVAYEGWGCVCSDWGEDTNAEYFSSDTQA

SEQ ID NO: 211707 - protein, 40 aa, Artificial Sequence
  Description of Artificial Sequence: Synthetic polypeptide
ADMCISTTNPVAYEGYGQCIVCSNWGYDDNAESFNSENQL

SEQ ID NO: 211708 - protein, 39 aa, Artificial Sequence
  Description of Artificial Sequence: Synthetic polypeptide
ADMCLSTTNPVAYEQYGQCICSDWMEDDNAENSNSDTQS

SEQ ID NO: 211709 - protein, 40 aa, Artificial Sequence
  Description of Artificial Sequence: Synthetic polypeptide
SDAEIACVNPVAYEQYGQCAVCSTWMEDHNAEYFSSDTQS

SEQ ID NO: 211710 - protein, 40 aa, Artificial Sequence
  Description of Artificial Sequence: Synthetic polypeptide
SEMEISCTNPVAYEGYGQCQVCPYWGYDPNAEYFNSDNQF

SEQ ID NO: 211711 - protein, 40 aa, Artificial Sequence
  Description of Artificial Sequence: Synthetic polypeptide
DEACIATTNPVCYCEGYGQCTTQNWGEDDNAEGFISDTQS

SEQ ID NO: 211712 - protein, 40 aa, Artificial Sequence
  Description of Artificial Sequence: Synthetic polypeptide
DEAAISTTNPVSYEFQYGQCNCQNWGEDHNAENFSSETQS

SEQ ID NO: 211713 - protein, 39 aa, Artificial Sequence
  Description of Artificial Sequence: Synthetic polypeptide
TDACISTTNPCAYEQYGQCVCSNWGEDDNAEHFISDTAS

SEQ ID NO: 211714 - protein, 40 aa, Artificial Sequence
  Description of Artificial Sequence: Synthetic polypeptide
SEACISTVNPVAYEGYGQCQVCSNWGAPHNAENFGSDTQL

SEQ ID NO: 211715 - protein, 39 aa, Artificial Sequence
  Description of Artificial Sequence: Synthetic polypeptide
SEMAISTTNPCAYEGYGQCVCSNSEADHNAENFISDTQA

SEQ ID NO: 211716 - protein, 42 aa, Artificial Sequence
  Description of Artificial Sequence: Synthetic polypeptide
WPEEENIRVTWPVAPDPGQCYTEMEVISPGTNQEVPTIVNGF

SEQ ID NO: 211717 - protein, 39 aa, Artificial Sequence
  Description of Artificial Sequence: Synthetic polypeptide
SEMCISCTNPCAYEQYGQCVCSNSEADHNAENFISDTQA

SEQ ID NO: 211718 - protein, 39 aa, Artificial Sequence
  Description of Artificial Sequence: Synthetic polypeptide
SEMCISCTNPVAYEAYGQCVCSNWMEEHNAEGFISDTQS

SEQ ID NO: 211719 - protein, 40 aa, Artificial Sequence
  Description of Artificial Sequence: Synthetic polypeptide
AEEEISCTNPVAYEGYGQCQICSNWGEDDNAEYFMSDTQG

SEQ ID NO: 211720 - protein, 40 aa, Artificial Sequence
  Description of Artificial Sequence: Synthetic polypeptide
SEMCISTTNPVAYEAWGQCQVCSNWGEDHNAENSGSETQS

SEQ ID NO: 211721 - protein, 43 aa, Artificial Sequence
  Description of Artificial Sequence: Synthetic polypeptide
DENEIATTNPTCQLYYFEDPPYGSTVAVNSDGGQGGMNPNGEH

SEQ ID NO: 211722 - protein, 39 aa, Artificial Sequence
  Description of Artificial Sequence: Synthetic polypeptide
ADMEISTTNPCAYEGYGQCVCSNSEADDNAENFMSDTQS

SEQ ID NO: 211723 - protein, 39 aa, Artificial Sequence
  Description of Artificial Sequence: Synthetic polypeptide
DEAAISCTNCCATEGYGQCVCSNWGEDHNAENFTSDTQA

SEQ ID NO: 211724 - protein, 39 aa, Artificial Sequence
  Description of Artificial Sequence: Synthetic polypeptide
SEMCVSCTNPVAYEGYGQCVCSMWGEDHNDENFNSDNQI

SEQ ID NO: 211725 - protein, 40 aa, Artificial Sequence
  Description of Artificial Sequence: Synthetic polypeptide
SEAEIGCTNPVAYEGYGQCQFCSVWGEDDNAESFISDTQS

SEQ ID NO: 211726 - protein, 40 aa, Artificial Sequence
  Description of Artificial Sequence: Synthetic polypeptide
SEAEIACVNPVAYEQYGQCAVCGNWMEDHNAENFSSDTQS

SEQ ID NO: 211727 - protein, 40 aa, Artificial Sequence
  Description of Artificial Sequence: Synthetic polypeptide
SEAEIACVNPVAYEGYGQCQVCSTWMEDHNAEHFSSDTQS

SEQ ID NO: 211728 - protein, 39 aa, Artificial Sequence
  Description of Artificial Sequence: Synthetic polypeptide
DDACISCTNPVAYEGYGCIVCSNWGYDHNAESFSSETQL

SEQ ID NO: 211729 - protein, 39 aa, Artificial Sequence
  Description of Artificial Sequence: Synthetic polypeptide
DDACISCTNPVAYCGYGICVCSNWMEGDNAENFISEFQQ

SEQ ID NO: 211730 - protein, 40 aa, Artificial Sequence
  Description of Artificial Sequence: Synthetic polypeptide
SEACTSTTNPVATEGWGQCQVCSDWMEDTNAEYFISDTQA

SEQ ID NO: 211731 - protein, 39 aa, Artificial Sequence
  Description of Artificial Sequence: Synthetic polypeptide
SEMCISTVNPVAYEGYGQCVCSNSGEDHNAENIISEPQA

SEQ ID NO: 211732 - protein, 38 aa, Artificial Sequence
  Description of Artificial Sequence: Synthetic polypeptide
DETEIATTNPIAYAPWSGATTPANATDGPAEPKGSPQN

SEQ ID NO: 211733 - protein, 40 aa, Artificial Sequence
  Description of Artificial Sequence: Synthetic polypeptide
SEACISTTNPVATEGWGQCQVCSNWGEDDNAENSSSETQA

SEQ ID NO: 211734 - protein, 38 aa, Artificial Sequence
  Description of Artificial Sequence: Synthetic polypeptide
SEACISTTNPCAYEGYGCICSNWMEDPNAENFISDTQS

SEQ ID NO: 211735 - protein, 40 aa, Artificial Sequence
  Description of Artificial Sequence: Synthetic polypeptide
SEACIACVNPVAYEQYGQCQVCSTWMELHNAEHFSSDTQS

SEQ ID NO: 211736 - protein, 40 aa, Artificial Sequence
  Description of Artificial Sequence: Synthetic polypeptide
SDMCISTTNPVAYEQYGQCIVCSNWGYDHNAESFSSDTQL

SEQ ID NO: 211737 - protein, 39 aa, Artificial Sequence
  Description of Artificial Sequence: Synthetic polypeptide
SEACIACVNPVAYEGYGQCQVCSTWMEHNAEYFSSDTQS

SEQ ID NO: 211738 - protein, 39 aa, Artificial Sequence
  Description of Artificial Sequence: Synthetic polypeptide
SDNCLSTTNPVAYEGYGQCVCSMWGEPHNAESFLSDTQA

SEQ ID NO: 211739 - protein, 39 aa, Artificial Sequence
  Description of Artificial Sequence: Synthetic polypeptide
SDNCLSTTNPVAYEQYGQCVCQMWGEPDNAESFLSDTQA

SEQ ID NO: 211740 - protein, 39 aa, Artificial Sequence
  Description of Artificial Sequence: Synthetic polypeptide
AEACISTTNPCAYEAYGQCVCSNSEADDNAENFISDTQS

SEQ ID NO: 211741 - protein, 39 aa, Artificial Sequence
  Description of Artificial Sequence: Synthetic polypeptide
AEACISTTNPCATEGYGQCICSNWMEDPNAENFISDTQS

SEQ ID NO: 211742 - protein, 43 aa, Artificial Sequence
  Description of Artificial Sequence: Synthetic polypeptide
FCMCEGFRTTPAPDVATDEGHYNKSCVYSNTNLTTYPSYIERW

SEQ ID NO: 211743 - protein, 40 aa, Artificial Sequence
  Description of Artificial Sequence: Synthetic polypeptide
AEACISCTNPVAYEQYGQCQICSTWGEDDNDEYFMSDTQG

SEQ ID NO: 211744 - protein, 39 aa, Artificial Sequence
  Description of Artificial Sequence: Synthetic polypeptide
AEACISCTNPVAYEGYGICVCSNWEEDDNAENFMSDTQS

SEQ ID NO: 211745 - protein, 40 aa, Artificial Sequence
  Description of Artificial Sequence: Synthetic polypeptide
AEACISCTNPVATEQYGQCQICSNWEEDDNAEYFMSDTQG

SEQ ID NO: 211746 - protein, 40 aa, Artificial Sequence
  Description of Artificial Sequence: Synthetic polypeptide
AEAAIRCTNPVSTEGYGQCASCQNWGEDHNAEYFGSDTQA

SEQ ID NO: 211747 - protein, 40 aa, Artificial Sequence
  Description of Artificial Sequence: Synthetic polypeptide
AEAAIRCTNPVSYEQYGQCASCQNWGEDDNAEYFGSDTQA

SEQ ID NO: 211748 - protein, 39 aa, Artificial Sequence
  Description of Artificial Sequence: Synthetic polypeptide
AEACISCTNPCATEGYGQCVCSNWGEDDNAEHFISDTAS

SEQ ID NO: 211749 - protein, 39 aa, Artificial Sequence
  Description of Artificial Sequence: Synthetic polypeptide
AEACISCTNPCATEGYGQCVCSNSEADDNAENFISDTQS

SEQ ID NO: 211750 - protein, 40 aa, Artificial Sequence
  Description of Artificial Sequence: Synthetic polypeptide
SDMCISTTNPVATEQWGQCQVCSNWGEDHNAENSSSETQS

SEQ ID NO: 211751 - protein, 39 aa, Artificial Sequence
  Description of Artificial Sequence: Synthetic polypeptide
SDMCISCTNPVAYEGYGICVCSTWVEDDNTENFISQTQA

SEQ ID NO: 211752 - protein, 39 aa, Artificial Sequence
  Description of Artificial Sequence: Synthetic polypeptide
SDMCIATTNPVAYEGYGQCIVCSNWGEHNAESFISETQL

SEQ ID NO: 211753 - protein, 39 aa, Artificial Sequence
  Description of Artificial Sequence: Synthetic polypeptide
SDMCIACTNPVAYEGYGICVCSNWVEDDNTENFNSDTQA

SEQ ID NO: 211754 - protein, 39 aa, Artificial Sequence
  Description of Artificial Sequence: Synthetic polypeptide
SEACISCTNPVSYEGYGQCVCSMWVEDDNIEGFMSDNQS

SEQ ID NO: 211755 - protein, 39 aa, Artificial Sequence
  Description of Artificial Sequence: Synthetic polypeptide
AEACIVTTNPCAYEGYGQCICSNWMEDPNAENFNSDTQS

SEQ ID NO: 211756 - protein, 39 aa, Artificial Sequence
  Description of Artificial Sequence: Synthetic polypeptide
SEREISTTNPCAYEGYGICICGNWMEDPNAENFISDTQS

SEQ ID NO: 211757 - protein, 39 aa, Artificial Sequence
  Description of Artificial Sequence: Synthetic polypeptide
SERCIVTTNPCAYEGYGQCSCSNWMEDPNAENFISDTQS

SEQ ID NO: 211758 - protein, 40 aa, Artificial Sequence
  Description of Artificial Sequence: Synthetic polypeptide
SEMEISTTNPVAYEGWGQCQVCSNWGEDHNAENSISETQS

SEQ ID NO: 211759 - protein, 39 aa, Artificial Sequence
  Description of Artificial Sequence: Synthetic polypeptide
SERCISTTNPCAYEGYGQCICSNWMEDPNAENFNSDTQS

SEQ ID NO: 211760 - protein, 39 aa, Artificial Sequence
  Description of Artificial Sequence: Synthetic polypeptide
SDECISCTNPVAYEGYGICVCQTWVEDDNTEYFSSDTQA

SEQ ID NO: 211761 - protein, 39 aa, Artificial Sequence
  Description of Artificial Sequence: Synthetic polypeptide
SEACISTTNPCAYEGYGQCVCSNSEADHNAENFSSDTQA

SEQ ID NO: 211762 - protein, 40 aa, Artificial Sequence
  Description of Artificial Sequence: Synthetic polypeptide
AEACISTTNPVAYEGYGICQVCSNWEEDPNAENFMSDTQS

SEQ ID NO: 211763 - protein, 39 aa, Artificial Sequence
  Description of Artificial Sequence: Synthetic polypeptide
SDECISTVNPVAYEGYGQCVCSNSGEDHNAENISSEPQA

SEQ ID NO: 211764 - protein, 39 aa, Artificial Sequence
  Description of Artificial Sequence: Synthetic polypeptide
SDECLSTTNPVAYEGYGQCICSDWMEDDNAENSNSDTQS

SEQ ID NO: 211765 - protein, 40 aa, Artificial Sequence
  Description of Artificial Sequence: Synthetic polypeptide
SENEISCTNPVAYEGYGQCQVCSNWEEDHNAENFISEFQS

SEQ ID NO: 211766 - protein, 40 aa, Artificial Sequence
  Description of Artificial Sequence: Synthetic polypeptide
SDEEISTTNPVAYCGYGQCIVCSNWGEDHNAEYFSSDTQS

SEQ ID NO: 211767 - protein, 39 aa, Artificial Sequence
  Description of Artificial Sequence: Synthetic polypeptide
AEREISTTNPCAYEGWGQCICSNWMEDPNAENFGSDTQS

SEQ ID NO: 211768 - protein, 40 aa, Artificial Sequence
  Description of Artificial Sequence: Synthetic polypeptide
SENCISTTNPVAYEGYGICQVCSNWEEDHNAENFISEFQS

SEQ ID NO: 211769 - protein, 39 aa, Artificial Sequence
  Description of Artificial Sequence: Synthetic polypeptide
SEACIATTNPCAYEGYGQCVCSNSEADHNAENFISDTQS

SEQ ID NO: 211770 - protein, 39 aa, Artificial Sequence
  Description of Artificial Sequence: Synthetic polypeptide
AEACISTTNPVAYEGWGICVCSNWEEDHNAENFMSDTQS

SEQ ID NO: 211771 - protein, 40 aa, Artificial Sequence
  Description of Artificial Sequence: Synthetic polypeptide
AEAEISCTNPVAYCGYGICQVCSNWGEGDNAENFNSEFQQ

SEQ ID NO: 211772 - protein, 40 aa, Artificial Sequence
  Description of Artificial Sequence: Synthetic polypeptide
SEAEISCTNPCAYCQYWGQCVCSNWGEADNAENFNSDTQA

SEQ ID NO: 211773 - protein, 40 aa, Artificial Sequence
  Description of Artificial Sequence: Synthetic polypeptide
DQAEISTTNPVAYCGWGICQVCSNWGEGDNAEYFISDTQQ

SEQ ID NO: 211774 - protein, 38 aa, Artificial Sequence
  Description of Artificial Sequence: Synthetic polypeptide
DDSEVACTNPVSYEGYGCVCQNWMEDDNAEYFGSQTQA

SEQ ID NO: 211775 - protein, 39 aa, Artificial Sequence
  Description of Artificial Sequence: Synthetic polypeptide
DQACISTTNPVAYCGWGQCVCSNWGEGHNAEYFNSDTQQ

SEQ ID NO: 211776 - protein, 39 aa, Artificial Sequence
  Description of Artificial Sequence: Synthetic polypeptide
AEEAISTTNCCAYEGYGQCVCSNWGEDHNAENFTSDTQA

SEQ ID NO: 211777 - protein, 39 aa, Artificial Sequence
  Description of Artificial Sequence: Synthetic polypeptide
AQAEISTTNPVAYCGWGQCVCSNWGEGDNAEYFSSDTQQ

SEQ ID NO: 211778 - protein, 40 aa, Artificial Sequence
  Description of Artificial Sequence: Synthetic polypeptide
DDAEISTTNPVAYCAYGQCIVCSNWGEDHNAENFISDTQS

SEQ ID NO: 211779 - protein, 40 aa, Artificial Sequence
  Description of Artificial Sequence: Synthetic polypeptide
DDAEISTTNPVAYCGYGQCIVCQNWGEDHNAEYFGSDTQS

SEQ ID NO: 211780 - protein, 39 aa, Artificial Sequence
  Description of Artificial Sequence: Synthetic polypeptide
DEMCVSCTNPVAYEGYGQCVCQMWGEDHNDEYFNSDNQI

SEQ ID NO: 211781 - protein, 40 aa, Artificial Sequence
  Description of Artificial Sequence: Synthetic polypeptide
DDEEISCTNPCAYCGYWGQCVCSNWGEAHNAENFNSDTQA

SEQ ID NO: 211782 - protein, 39 aa, Artificial Sequence
  Description of Artificial Sequence: Synthetic polypeptide
DEMCLSTTNPVAYEGWGQCSCSNWMEDHNAEFFISVTQP

SEQ ID NO: 211783 - protein, 41 aa, Artificial Sequence
  Description of Artificial Sequence: Synthetic polypeptide
CEEACIRTVNPCAYEFGYGQCVCGNWGEDHNIENFGSDNQA

SEQ ID NO: 211784 - protein, 40 aa, Artificial Sequence
  Description of Artificial Sequence: Synthetic polypeptide
DDEEISCTNPVAYCGYGQCIVCSNWGEDHNAENFISDTQS

SEQ ID NO: 211785 - protein, 42 aa, Artificial Sequence
  Description of Artificial Sequence: Synthetic polypeptide
MEPEVPTMTTMTNCNRAFEMQIEFGHPVETDTANDSRIGDNR

SEQ ID NO: 211786 - protein, 39 aa, Artificial Sequence
  Description of Artificial Sequence: Synthetic polypeptide
AEECISCTNPVAYEGYGCQICSNWEEDHNIEFFFSDTQQ

SEQ ID NO: 211787 - protein, 42 aa, Artificial Sequence
  Description of Artificial Sequence: Synthetic polypeptide
DANEIATTNPTCYYYFEPPPYGSTVAVNSDGGQGGMNPNGQN

SEQ ID NO: 211788 - protein, 38 aa, Artificial Sequence
  Description of Artificial Sequence: Synthetic polypeptide
DDSEVACTNPVSYEGYGCVCFNWGEDHNAEYFGSQTQA

SEQ ID NO: 211789 - protein, 39 aa, Artificial Sequence
  Description of Artificial Sequence: Synthetic polypeptide
DEMCIVCTNPCAYEGYGQCICSNWMEDPNAENFNSDTQS

SEQ ID NO: 211790 - protein, 39 aa, Artificial Sequence
  Description of Artificial Sequence: Synthetic polypeptide
ADECISCTNPVGYEQYGQCVCSNWGEDHNIEHFISETQM

SEQ ID NO: 211791 - protein, 39 aa, Artificial Sequence
  Description of Artificial Sequence: Synthetic polypeptide
DDECISCTNPCAYEGYGQCVCSNSEADHNAENFSSDTQA

SEQ ID NO: 211792 - protein, 40 aa, Artificial Sequence
  Description of Artificial Sequence: Synthetic polypeptide
VEDEIACTNPVGYTEAAPWCGPHPFAVGADTQDRGPADQP

SEQ ID NO: 211793 - protein, 39 aa, Artificial Sequence
  Description of Artificial Sequence: Synthetic polypeptide
NDAELSTTNPVAYEGYGQCICSDWMEDDNAENSNSDTQS

SEQ ID NO: 211794 - protein, 39 aa, Artificial Sequence
  Description of Artificial Sequence: Synthetic polypeptide
AEMAISCTNPVSTEGYGCASCQNWGEDDNAEYFGSDTQA

SEQ ID NO: 211795 - protein, 40 aa, Artificial Sequence
  Description of Artificial Sequence: Synthetic polypeptide
NEACIRTTNPVAYCGYGQCQICSNWGEDENTEGFNSDNAS

SEQ ID NO: 211796 - protein, 39 aa, Artificial Sequence
  Description of Artificial Sequence: Synthetic polypeptide
NEACISTTNPVAYCGYGQCICSNWGEDENTEGFNSDTAS

SEQ ID NO: 211797 - protein, 39 aa, Artificial Sequence
  Description of Artificial Sequence: Synthetic polypeptide
CDECISTTNPVAYEGWGQCVCENWEEDDNQEYSISDTQA

SEQ ID NO: 211798 - protein, 40 aa, Artificial Sequence
  Description of Artificial Sequence: Synthetic polypeptide
AEMCIRTTNPVAYEGWGQCQVCSNWGEDHNAENSISETQS

SEQ ID NO: 211799 - protein, 39 aa, Artificial Sequence
  Description of Artificial Sequence: Synthetic polypeptide
AEMCISCTNPVAYEGYGICVCSNSEEDHNAENFMSDTQS

SEQ ID NO: 211800 - protein, 39 aa, Artificial Sequence
  Description of Artificial Sequence: Synthetic polypeptide
AEMCISTTNPCAYEEYGQCVCSNWMEDHNEEGFSSDTQS

SEQ ID NO: 211801 - protein, 39 aa, Artificial Sequence
  Description of Artificial Sequence: Synthetic polypeptide
ADECIGTTNPCAYEGYGQCVCSNSEADHNAENFISDTQS

SEQ ID NO: 211802 - protein, 39 aa, Artificial Sequence
  Description of Artificial Sequence: Synthetic polypeptide
AEMCISTTNPCAYEGYGQCVCSNSEADHNAENFISDTQS

SEQ ID NO: 211803 - protein, 40 aa, Artificial Sequence
  Description of Artificial Sequence: Synthetic polypeptide
AEMCISTTNPVATEGWGQCQVCSNWGEDHNAENSSSETQS

SEQ ID NO: 211804 - protein, 40 aa, Artificial Sequence
  Description of Artificial Sequence: Synthetic polypeptide
CDACIRTTNPVATEGWGQCQTCGNWGADNNIENFGSDTQA

SEQ ID NO: 211805 - protein, 40 aa, Artificial Sequence
  Description of Artificial Sequence: Synthetic polypeptide
DAQQIATTNPVAYEPWGHSPICAGMTAGIGIATGGDNMQP

SEQ ID NO: 211806 - protein, 41 aa, Artificial Sequence
  Description of Artificial Sequence: Synthetic polypeptide
DEMAIATTNPVAYEGYYGQCQVCVNWGADHNAEHFNSDTQA

SEQ ID NO: 211807 - protein, 37 aa, Artificial Sequence
  Description of Artificial Sequence: Synthetic polypeptide
DETEIAATNPCAYAPWGNTTPANATDGPAEPKGSPMN

SEQ ID NO: 211808 - protein, 40 aa, Artificial Sequence
  Description of Artificial Sequence: Synthetic polypeptide
DDACISTTNPVAYEGYGICIVCSNWGYDHNAESFISETQS

SEQ ID NO: 211809 - protein, 39 aa, Artificial Sequence
  Description of Artificial Sequence: Synthetic polypeptide
DEACISCTNPCAYEGYGQCICSNWMEDPNAENFGSDTQS

SEQ ID NO: 211810 - protein, 38 aa, Artificial Sequence
  Description of Artificial Sequence: Synthetic polypeptide
DETEIACTNPTAYACWGATTYANATDGPAEPANNPKNP

SEQ ID NO: 211811 - protein, 40 aa, Artificial Sequence
  Description of Artificial Sequence: Synthetic polypeptide
DDACISTTNPVAYCQYGICIVCSNWGEDHNAENFISDTQS

SEQ ID NO: 211812 - protein, 39 aa, Artificial Sequence
  Description of Artificial Sequence: Synthetic polypeptide
AEAAISTVNPVAYEEYGQCVCSNWGEDDNTEHFISDPQS

SEQ ID NO: 211813 - protein, 39 aa, Artificial Sequence
  Description of Artificial Sequence: Synthetic polypeptide
SEAETSCTNPVAYEGWGQCVCSDWGEDTNAEYFSSDTQA

SEQ ID NO: 211814 - protein, 40 aa, Artificial Sequence
  Description of Artificial Sequence: Synthetic polypeptide
SEAEISTVNPVAYEYYGQCIVCSNWGEAHNAENFTSDTQP

SEQ ID NO: 211815 - protein, 39 aa, Artificial Sequence
  Description of Artificial Sequence: Synthetic polypeptide
DDACISTTNPVAYCGYGQCVCSNWGPDHNIEYFISDTQA

SEQ ID NO: 211816 - protein, 41 aa, Artificial Sequence
  Description of Artificial Sequence: Synthetic polypeptide
CEDEIATTNPVGYTEAAWCGPHVAVLAGDGMMNDSGGPNDQ

SEQ ID NO: 211817 - protein, 39 aa, Artificial Sequence
  Description of Artificial Sequence: Synthetic polypeptide
DETEIAATNPCAYAPWGHNTTAALATDGPANPKMNPQNA

SEQ ID NO: 211818 - protein, 43 aa, Artificial Sequence
  Description of Artificial Sequence: Synthetic polypeptide
HWEFVADIRTTNPAAPTEQGNGYQFAETGNPGNVQRYDVENLL

SEQ ID NO: 211819 - protein, 37 aa, Artificial Sequence
  Description of Artificial Sequence: Synthetic polypeptide
DEGEIATTNPCAYAPWGATTAAMATDGPAEPKPSPQN

SEQ ID NO: 211820 - protein, 40 aa, Artificial Sequence
  Description of Artificial Sequence: Synthetic polypeptide
SEECISTTNPCAYEGYGQCQVCSNSEADHNAENFISDTQS

SEQ ID NO: 211821 - protein, 38 aa, Artificial Sequence
  Description of Artificial Sequence: Synthetic polypeptide
DETEIAATNPCAYAPWGHATTSANATDGPAEPKGSPEN

SEQ ID NO: 211822 - protein, 40 aa, Artificial Sequence
  Description of Artificial Sequence: Synthetic polypeptide
SEEAISTTNPVSTEFGYGQCNCQNWPEDHNAENFSSETQA

SEQ ID NO: 211823 - protein, 40 aa, Artificial Sequence
  Description of Artificial Sequence: Synthetic polypeptide
TEEEIACTNPVAYYEPNWGGCFPCAPAGELIGGPMEDTDK

SEQ ID NO: 211824 - protein, 41 aa, Artificial Sequence
  Description of Artificial Sequence: Synthetic polypeptide
CQENDCIAWCTNPTVYATYEPPVWGQSSANMNLIHPGQLKH

SEQ ID NO: 211825 - protein, 40 aa, Artificial Sequence
  Description of Artificial Sequence: Synthetic polypeptide
DDECISCTNPCAYCGYWGQCVCSNWGEADNAENFGSDTQA

SEQ ID NO: 211826 - protein, 40 aa, Artificial Sequence
  Description of Artificial Sequence: Synthetic polypeptide
AEMAIRCTNPVSYEGYGQCASCQNWPEDDNAEYFGSDTQA

SEQ ID NO: 211827 - protein, 40 aa, Artificial Sequence
  Description of Artificial Sequence: Synthetic polypeptide
DEMCISTVNPVAYEGWGQCQVCSNWGAPHNAEFFSSDTQL

SEQ ID NO: 211828 - protein, 41 aa, Artificial Sequence
  Description of Artificial Sequence: Synthetic polypeptide
SEAEISCTNPVAYETGYGICQVCSNWGEDPNAENFISDTQL

SEQ ID NO: 211829 - protein, 39 aa, Artificial Sequence
  Description of Artificial Sequence: Synthetic polypeptide
SDMCISTTNPVSYEGYGQCVCSMWVEDDNIEGFMSDTQS

SEQ ID NO: 211830 - protein, 39 aa, Artificial Sequence
  Description of Artificial Sequence: Synthetic polypeptide
NEMEISCTNPVAYCGYGQCICSNWMEDENTEGFISDTAS

SEQ ID NO: 211831 - protein, 39 aa, Artificial Sequence
  Description of Artificial Sequence: Synthetic polypeptide
AEMALSCTNPVAYEGYGQCQVCSNWGEHNAESIDSEPAA

SEQ ID NO: 211832 - protein, 40 aa, Artificial Sequence
  Description of Artificial Sequence: Synthetic polypeptide
AEMALSTTNPVAYEGYGQCQVCSNWGEDDNAENIDSEPAG

SEQ ID NO: 211833 - protein, 40 aa, Artificial Sequence
  Description of Artificial Sequence: Synthetic polypeptide
AEMALSTTNPVAYEGYGQCQVCSNWGEDHNAESIDSEPAS

SEQ ID NO: 211834 - protein, 39 aa, Artificial Sequence
  Description of Artificial Sequence: Synthetic polypeptide
NEMAISCTNPLAYEGYGQCVCSNSVEDPNAEHFSSDTQS

SEQ ID NO: 211835 - protein, 40 aa, Artificial Sequence
  Description of Artificial Sequence: Synthetic polypeptide
DSSDCYAACPTNPVAYEQWGSICAMTPAEGQMHQGDIQAM

SEQ ID NO: 211836 - protein, 41 aa, Artificial Sequence
  Description of Artificial Sequence: Synthetic polypeptide
FEGVTIWIGTTENPVAHIWEYRSCVILAWTLGYQHTCVQNT

SEQ ID NO: 211837 - protein, 39 aa, Artificial Sequence
  Description of Artificial Sequence: Synthetic polypeptide
SEACIACVNPVAYEGYGQCAVCQTWMEHNAEHFSSDTQS

SEQ ID NO: 211838 - protein, 40 aa, Artificial Sequence
  Description of Artificial Sequence: Synthetic polypeptide
SEAALSCTNPVAYEQYGQCQVCSNWGEDDNAENIDSEPAG

SEQ ID NO: 211839 - protein, 39 aa, Artificial Sequence
  Description of Artificial Sequence: Synthetic polypeptide
DDACLSTTNPVAYEGYGQCICSDWMEDDNAEYSSSDTQA

SEQ ID NO: 211840 - protein, 41 aa, Artificial Sequence
  Description of Artificial Sequence: Synthetic polypeptide
CEEEIATTNPVGYTEAAWCGPHAVAVLAGDGMEDSGGPQDQ

SEQ ID NO: 211841 - protein, 40 aa, Artificial Sequence
  Description of Artificial Sequence: Synthetic polypeptide
SEYEIACVNPVAYEQWGQCAVCSNSMEDHNAEHFSSDTQS

SEQ ID NO: 211842 - protein, 40 aa, Artificial Sequence
  Description of Artificial Sequence: Synthetic polypeptide
SDAAIATTNPVAYEGGYGICVCSNWGEPHNAENFSSDTQS

SEQ ID NO: 211843 - protein, 40 aa, Artificial Sequence
  Description of Artificial Sequence: Synthetic polypeptide
SDAAISTTNPVAYEGQWGQCVCSNWGEPHNAENFSSDTQA

SEQ ID NO: 211844 - protein, 41 aa, Artificial Sequence
  Description of Artificial Sequence: Synthetic polypeptide
CEEEIATTNPVGYTEAAWCGPHVAVLAGDGMVVDSGGPQDQ

SEQ ID NO: 211845 - protein, 40 aa, Artificial Sequence
  Description of Artificial Sequence: Synthetic polypeptide
SDACISCTNPVAYEGYGICQVCSNWVEDDNTEYFGSDTQA

SEQ ID NO: 211846 - protein, 42 aa, Artificial Sequence
  Description of Artificial Sequence: Synthetic polypeptide
TEQHVISFTNVNVPVAYEAWGICTYSCFGNELSQNPVGANNW

SEQ ID NO: 211847 - protein, 39 aa, Artificial Sequence
  Description of Artificial Sequence: Synthetic polypeptide
SDACISCTNPVSTEGYGICVCSMWVEDDNIEGFMSDTQS

SEQ ID NO: 211848 - protein, 40 aa, Artificial Sequence
  Description of Artificial Sequence: Synthetic polypeptide
LMTPEIISSVTNPRVPVVVVYIMHQTSTINNIQQFTVNVR

SEQ ID NO: 211849 - protein, 43 aa, Artificial Sequence
  Description of Artificial Sequence: Synthetic polypeptide
DHSECWITRTTNMMEVTEPVYFSSHQTCYTWAPCQTRGDNLEE

SEQ ID NO: 211850 - protein, 41 aa, Artificial Sequence
  Description of Artificial Sequence: Synthetic polypeptide
DLETIHVRLTTCAVYTYLQAWGEIARHWTVNLKFRNIEDMM

SEQ ID NO: 211851 - protein, 39 aa, Artificial Sequence
  Description of Artificial Sequence: Synthetic polypeptide
AEECISTTNSCAYEGYGQCVCQDWGEDHNAENSMSDTAS

SEQ ID NO: 211852 - protein, 40 aa, Artificial Sequence
  Description of Artificial Sequence: Synthetic polypeptide
IWEANIRTTNPKSTDQIYIFWTRETIVPMMEQHYGMEGWN

SEQ ID NO: 211853 - protein, 40 aa, Artificial Sequence
  Description of Artificial Sequence: Synthetic polypeptide
SEMEIACVNPVAYEEYGQCAVCSNWMEDHNAEGFSSDTQS

SEQ ID NO: 211854 - protein, 39 aa, Artificial Sequence
  Description of Artificial Sequence: Synthetic polypeptide
TNVATEQYGVVTTNNDGIGDEAEIYESIISENLIFEGIR

SEQ ID NO: 211855 - protein, 41 aa, Artificial Sequence
  Description of Artificial Sequence: Synthetic polypeptide
DQECIRCTNPVAYEGYGGQCQYCYNWMEDDNAESFNSDTQA

SEQ ID NO: 211856 - protein, 40 aa, Artificial Sequence
  Description of Artificial Sequence: Synthetic polypeptide
SEAEIACVNPVATEGWGQCQVCSNWMEDHNAEYFSSDTQS

SEQ ID NO: 211857 - protein, 40 aa, Artificial Sequence
  Description of Artificial Sequence: Synthetic polypeptide
TDMCISTTNPVAYEGYGQCIVCSNWGYDHNAESFSSETQL

SEQ ID NO: 211858 - protein, 40 aa, Artificial Sequence
  Description of Artificial Sequence: Synthetic polypeptide
DEACISCTNPCAYCQYWGQCVCSNWGEADNAENFISDTQA

SEQ ID NO: 211859 - protein, 40 aa, Artificial Sequence
  Description of Artificial Sequence: Synthetic polypeptide
DENEIAATNPTCQLYYEPYGTTPSAMEWDQAQQNPQDVHK

SEQ ID NO: 211860 - protein, 40 aa, Artificial Sequence
  Description of Artificial Sequence: Synthetic polypeptide
DEMAIGTTNPVSYEFGYGQCNCQNWGEDHNAENFSSETQA

SEQ ID NO: 211861 - protein, 39 aa, Artificial Sequence
  Description of Artificial Sequence: Synthetic polypeptide
DDRCISTTNPCAYEGYGQCICSNWMEDPNAENFSSDTQS

SEQ ID NO: 211862 - protein, 39 aa, Artificial Sequence
  Description of Artificial Sequence: Synthetic polypeptide
DQECISTVNPCSTEAWGICAVCQNWGEDNAEHFNSDTQA

SEQ ID NO: 211863 - protein, 40 aa, Artificial Sequence
  Description of Artificial Sequence: Synthetic polypeptide
DQECIRTVNPCSYEAWGICAVCSNWGEDDNAEHFISDNQA

SEQ ID NO: 211864 - protein, 42 aa, Artificial Sequence
  Description of Artificial Sequence: Synthetic polypeptide
IVVESILIVPATSTQEQRIQPEQYIGQSNSITNHDQTDLNDD

SEQ ID NO: 211865 - protein, 40 aa, Artificial Sequence
  Description of Artificial Sequence: Synthetic polypeptide
SQEEISTVNPCSTEAWGICAVCSNWGEDDNAEHFISDTQA

SEQ ID NO: 211866 - protein, 40 aa, Artificial Sequence
  Description of Artificial Sequence: Synthetic polypeptide
SEACIACVNPVAYEGYGQCAVCSNWMEPHNAEYFSSDTQS

SEQ ID NO: 211867 - protein, 40 aa, Artificial Sequence
  Description of Artificial Sequence: Synthetic polypeptide
SEMCIACVNPVAYEGYGQCAVCSNWMEAHNAEHFSSDTQS

SEQ ID NO: 211868 - protein, 42 aa, Artificial Sequence
  Description of Artificial Sequence: Synthetic polypeptide
SESEEIRTTTYECWGSVCTQWGTTVYCEDNQNDDRRQHNVEV

SEQ ID NO: 211869 - protein, 40 aa, Artificial Sequence
  Description of Artificial Sequence: Synthetic polypeptide
SEACIACVNPVAYEGYGQCAVCSNSMEDHNAEHFSSDTQS

SEQ ID NO: 211870 - protein, 39 aa, Artificial Sequence
  Description of Artificial Sequence: Synthetic polypeptide
SEACISCTNPVAYCGYGICVCSNWGPDHDAEYFISDTQA

SEQ ID NO: 211871 - protein, 41 aa, Artificial Sequence
  Description of Artificial Sequence: Synthetic polypeptide
TEVNVITYSCTNPCAYEPWGISVVVRATGDESSGRTSGEQS

SEQ ID NO: 211872 - protein, 40 aa, Artificial Sequence
  Description of Artificial Sequence: Synthetic polypeptide
DCENAAIRVVPCVAMDQEQTYTYIFFSTLQLDEIPMSAFQ
